US008778870B2

(12) United States Patent
Madison et al.

(10) Patent No.: US 8,778,870 B2
(45) Date of Patent: Jul. 15, 2014

(54) MODIFIED FACTOR IX POLYPEPTIDES AND USES THEREOF

(75) Inventors: Edwin L. Madison, San Francisco, CA (US); Christopher Thanos, San Francisco, CA (US); Grant Ellsworth Blouse, Copenhagen S (DK)

(73) Assignee: Catalyst Biosciences, Inc., South San Francisco, CA (US)

( * ) Notice: Subject to any disclaimer, the term of this patent is extended or adjusted under 35 U.S.C. 154(b) by 0 days.

(21) Appl. No.: 13/373,118

(22) Filed: Nov. 3, 2011

(65) Prior Publication Data
US 2012/0308540 A1 Dec. 6, 2012
US 2013/0177541 A9 Jul. 11, 2013

Related U.S. Application Data

(60) Provisional application No. 61/456,298, filed on Nov. 3, 2010.

(51) Int. Cl.
*A61K 38/00* (2006.01)
*A61K 38/36* (2006.01)
*A61K 38/43* (2006.01)
*C12N 9/64* (2006.01)

(52) U.S. Cl.
CPC ......... *C12N 9/644* (2013.01); *C12Y 304/21022* (2013.01)
USPC .......................... 514/1.1; 514/13.7; 514/14.2

(58) Field of Classification Search
None
See application file for complete search history.

(56) References Cited

U.S. PATENT DOCUMENTS

| | | | |
|---|---|---|---|
| 4,522,811 A | 6/1985 | Eppstein et al. | 514/2.4 |
| 4,784,950 A | 11/1988 | Hagen et al. | 435/69.6 |
| 4,892,538 A | 1/1990 | Aebischer et al. | 604/891.1 |
| 4,952,496 A | 8/1990 | Studier et al. | 435/91.41 |
| 5,033,252 A | 7/1991 | Carter | 53/425 |
| 5,052,558 A | 10/1991 | Carter | 206/439 |
| 5,283,187 A | 2/1994 | Aebischer et al. | 435/182 |
| 5,323,907 A | 6/1994 | Kalvelage | 206/531 |
| 5,621,039 A | 4/1997 | Hallahan et al. | 525/54.1 |
| 5,639,857 A | 6/1997 | Zimmermann | 530/384 |
| 5,672,662 A | 9/1997 | Harris et al. | 525/408 |
| 5,788,965 A | 8/1998 | Berkner et al. | 424/94.64 |
| 5,824,639 A | 10/1998 | Berkner | 514/14.3 |
| 5,837,679 A | 11/1998 | Wolf et al. | 514/13.5 |
| 5,969,040 A | 10/1999 | Hallahan et al. | 525/54.1 |
| 6,017,882 A | 1/2000 | Nelsestuen | 514/14.9 |
| 6,100,061 A | 8/2000 | Reiter et al. | 435/69.1 |
| 6,315,995 B1 | 11/2001 | Pinsky et al. | 424/94.63 |
| 6,423,826 B1 | 7/2002 | Nelsestuen | 530/345 |
| 6,531,298 B2 | 3/2003 | Stafford et al. | 435/69.6 |
| 6,737,505 B2 | 5/2004 | Bentley et al. | 528/425 |
| 6,762,286 B2 | 7/2004 | Nelsestuen | 530/380 |
| 6,936,441 B2 | 8/2005 | Reiter et al. | 435/69.6 |
| 7,125,841 B2 | 10/2006 | Sheehan | 514/13.5 |
| 7,416,861 B2 | 8/2008 | Persson et al. | 435/69.1 |
| 7,419,949 B2 | 9/2008 | Hedner | 514/2 |
| 7,432,352 B2 | 10/2008 | Johansen | 530/350 |
| 7,575,897 B2 | 8/2009 | Scheiflinger et al. | 435/69.1 |
| 7,700,734 B2 | 4/2010 | Lin et al. | 530/384 |
| 8,211,428 B2 | 7/2012 | Madison | 424/94.64 |
| 8,383,388 B2 | 2/2013 | Oyhenart et al. | 435/226 |
| 8,445,245 B2 | 5/2013 | Ruggles et al. | 435/183 |
| 8,519,103 B2 | 8/2013 | Madison et al. | 530/384 |
| 2002/0166130 A1 | 11/2002 | Velander et al. | 800/7 |
| 2003/0211094 A1 | 11/2003 | Nelsestuen | 424/94.63 |
| 2004/0110675 A1 | 6/2004 | Sheehan | 514/13.5 |
| 2004/0133930 A1 | 7/2004 | Cooper et al. | 800/7 |
| 2004/0146938 A1 | 7/2004 | Nguyen | 435/7.1 |
| 2004/0235734 A1 | 11/2004 | Bossard et al. | 530/383 |
| 2004/0254106 A1 | 12/2004 | Carr et al. | 530/381 |
| 2005/0147618 A1 | 7/2005 | Rivera et al. | 424/178.1 |
| 2006/0104968 A1 | 5/2006 | Bookbinder et al. | 424/94.61 |
| 2006/0204473 A1 | 9/2006 | Blatt et al. | 424/85.5 |
| 2006/0264373 A1 | 11/2006 | Nelsestuen | 514/12 |
| 2007/0093443 A1 | 4/2007 | Madison | 514/44 |
| 2007/0117756 A1 | 5/2007 | Haaning et al. | 514/14.3 |
| 2007/0254840 A1 | 11/2007 | Nelsestuen | 514/14.3 |
| 2008/0050772 A1 | 2/2008 | DeFrees et al. | 435/68.1 |
| 2008/0102115 A1* | 5/2008 | Oyhenart et al. | 424/457 |

(Continued)

FOREIGN PATENT DOCUMENTS

| | | |
|---|---|---|
| EP | 2 316 930 | 5/2011 |
| WO | WO 01/32711 | 5/2001 |
| WO | WO 01/58935 | 8/2001 |
| WO | WO 02/40544 | 5/2002 |
| WO | WO 2004/031733 | 4/2004 |
| WO | WO 2004/083361 | 9/2004 |
| WO | WO 2004/101741 | 11/2004 |
| WO | WO 2004/111242 | 12/2004 |
| WO | WO 2006/114105 | 11/2006 |
| WO | WO 2007/022512 | 2/2007 |

(Continued)

OTHER PUBLICATIONS

Kisiel et al., Proteolytic Inactivation of Blood Coagulation Factor IX by Thrombin, Blood, vol. 66, No. 6 (Dec.) 1985, pp. 1302-1308.*
Letter/Written Disclosure of the Supplemental Information Disclosure Statement for the above-referenced application, mailed on the same day herewith, 2 pages.
Written Opinion, issued Dec. 10, 2012, in connection with corresponding International Patent Application No. PCT/US11/59233, 8 pages.

(Continued)

*Primary Examiner* — Karlheinz R Skowronek
*Assistant Examiner* — Joseph Fischer
(74) *Attorney, Agent, or Firm* — McKenna Long & Aldridge LLP; Stephanie Seidman

(57) ABSTRACT

Modified Factor IX (FIX) polypeptides and uses thereof are provided. Such modified FIX polypeptides include FIXa and other forms of FIX. Among the modified FIX polypeptides provided are those that have altered activities, typically altered procoagulant activity, including increased procoagulant activities. Hence, such modified polypeptides are therapeutics.

37 Claims, 6 Drawing Sheets

(56) References Cited

U.S. PATENT DOCUMENTS

| | | | |
|---|---|---|---|
| 2008/0146494 A1 | 6/2008 | DeFrees et al. | 424/85.2 |
| 2008/0167219 A1 | 7/2008 | Lin et al. | 530/384 |
| 2008/0176287 A1 | 7/2008 | Scheiflinger et al. | 435/69.6 |
| 2008/0187955 A1 | 8/2008 | DeFrees et al. | 435/68.1 |
| 2008/0188414 A1 | 8/2008 | Bossard et al. | 514/14.2 |
| 2008/0206808 A1 | 8/2008 | DeFrees et al. | 435/68.1 |
| 2008/0214461 A1 | 9/2008 | Dockal et al. | 514/14.2 |
| 2008/0280818 A1 | 11/2008 | DeFrees | 514/1.1 |
| 2009/0047210 A1 | 2/2009 | Nguyen | 424/1.1 |
| 2009/0055942 A1 | 2/2009 | Ostergaard | 800/13 |
| 2009/0098103 A1 | 4/2009 | Madison | 424/94.64 |
| 2009/0123452 A1 | 5/2009 | Madison | 424/94.64 |
| 2009/0136477 A1 | 5/2009 | Nguyen | 424/94.64 |
| 2009/0291890 A1 | 11/2009 | Madison | 514/14.3 |
| 2010/0166729 A9 | 7/2010 | Madison | 424/94.64 |
| 2010/0330059 A1 | 12/2010 | Stafford et al. | 424/94.3 |
| 2012/0244139 A1 | 9/2012 | Madison et al. | 424/94.63 |
| 2012/0301945 A1 | 11/2012 | Madison et al. | 435/219 |
| 2012/0308551 A1 | 12/2012 | Madison | 424/94.64 |
| 2013/0164820 A9 | 6/2013 | Madison | 435/219 |
| 2013/0243855 A1 | 9/2013 | Oyhenart et al. | 424/463 |

FOREIGN PATENT DOCUMENTS

| | | |
|---|---|---|
| WO | WO 2007/031559 | 3/2007 |
| WO | WO 2007/047995 | 4/2007 |
| WO | WO 2007/112005 | 10/2007 |
| WO | WO 2007/135182 | 11/2007 |
| WO | WO 2007/149406 | 12/2007 |
| WO | WO 2008/082613 | 7/2008 |
| WO | WO 2008/090215 | 7/2008 |
| WO | WO 2008/119815 | 10/2008 |
| WO | WO 2008/127702 | 10/2008 |
| WO | WO 2009/051717 | 4/2009 |
| WO | WO 2009/126307 | 10/2009 |
| WO | WO 2009/130198 | 10/2009 |
| WO | WO 2009/137254 | 11/2009 |
| WO | WO 2009/140015 | 11/2009 |
| WO | WO 2010/012451 | 2/2010 |
| WO | WO 2010/029178 | 3/2010 |
| WO | WO 2010029178 A1 * | 3/2010 |
| WO | WO 2012/061654 | 5/2012 |

OTHER PUBLICATIONS

Response to the Written Opinion, submitted Feb. 11, 2013, in connection with corresponding International Patent Application No. PCT/US11/59233, 75 pages.

International Preliminary Report on Patentability, issued Feb. 21, 2013, in connection with corresponding International Patent Application No. PCT/US11/59233, 8 pages.

Pusateri et al., "Mechanistic implications for the use and monitoring of recombinant activated factor VII in trauma," Crit. Care 9:S15-S24 (2005).

Rohlena et al., "Chapter III: Role of surface loop 340-347 in the catalytic activity of human blood coagulation factor IX" in thesis entitled "Molecular interactions between coagulation factor IX and low density lipoprotein receptor-related protein," Univ. of Utrecht, pp. 37-48 (2004).

Schwartz, R., "Factor IX overview," Medscape Reference, Published on Feb. 27, 2012 [online][retrieved on Jul. 5, 2012] Retrieved from: <URL:emedicine.medscape.com/article/199088-overview [106 pages].

Stoilova-McPhie et al., "3-Dimensional structure of membrane-bound coagulation factor VIII: modeling of the factor VIII heterodimer within a 3-dimensional density map derived by electron crystallography," Blood 99(4):1215-1223 (2002).

Adams et al., "The c-myc oncogene driven by immunoglobulin enhancers induces lymphoid malignancy in transgenic mice," Nature 318:533-538 (1985).

Agarwala et al., "Activation peptide of human factor IX has oligosaccharides O-glycosidically linked to threonine residues at 159 and 169," Biochem. 33(17):5167-5171 (1994).

Aktimur et al., "The factor IX γ-carboxyglutamic acid (Gla) domain is involved in interactions between factor IX and factor XIa," J. Biol. Chem. 278(10):7981-7987 (2003).

Alexander et al., "Expression of the c-myc oncogene under control of an immunoglobulin enhancer in Eμ-myc transgenic mice," Mol. Cell. Biol. 7(4):1436-1444 (1987).

Allen et al., "A variant of recombinant factor VIIa with enhanced procoagulant and antifibrinolytic activities in an in vitro model of hemophilia," Arterioscler. Thromb. Vasc. Biol. 27(3):683-689 (2007).

Altschul et al., "Basic local alignment search tool," J. Mol. Biol. 215:403-410 (1990).

Autin et al., "Molecular models of the procoagulant factor VIIIa-factor IXa complex," J. Thromb. Haemost. 3(9):2044-2056 (2005).

Bajaj et al., "Factor IXa:factor VIIIa interaction. Helix 330-338 of factor IXa interacts with residues 558-565 and spatially adjacent regions of the a2 subunit of factor VIIIa," J. Biol. Chem. 276(19):16302-16309 (2001).

Becker et al., "Endothelial function and hemostasis," Z. Kardiol. 89(3):160-167 (2000).

Begbie et al., "An important role for the activation peptide domain in controlling factor IX levels in the blood of haemophilia B mice," Thromb. Haemostasis 94:1138-1147 (2005).

Benoist et al., "In vivo sequence requirements of the SV40 early promoter region," Nature 290:304-310 (1981).

Berkner, "The vitamin K-dependent carboxylase," J. Nutr: 130(8):1877-1880 (2000).

BioWorld Today, "Other News to Note," BioWorld Today 21(243):2 (2010).

Bjelke et al., "A loop of coagulation factor VIIa influencing macromolecular substrate specificity," FEBS Lett. 581(1):71-76 (2007).

Blostein et al., "The Gla domain of factor IXa binds to factor VIIIa in the tenase complex," J. Biol. Chem. 278(33):31297-31302 (2003).

Bock et al., "Isolation of human blood coagulation a-factor Xa by soybean trypsin inhibitor—sepharose chromatography and its active-site titration with fluorescein mono-p-guanidinobenzoate," Arch. Biochem. Biophys. 273(2):375-388 (1989).

Bowen, "Haemophilia A and haemophilia B: molecular insights," Mol. Pathol. 55:1-18 (2002).

Branden et al., "Prediction, engineering, and design of protein structures," in Introduction to Protein Structure, Garland Publishing Inc., New York, New York, p. 247 (1991).

Brinster et al., "Regulation of metallothionein-thymidine kinase fusion plasmids injected into mouse eggs," Nature 296:39-42 (1982).

Buyue et al., "The heparin-binding exosite of factor IXa is a critical regulator of plasma thrombin generation and venous thrombosis," Blood 112(8):3234-3241 (2008).

Carrillo et al., "The multiple sequence alignment problem in biology," SIAM J. Appl. Math. 48:1073-1082 (1988).

Chang et al., "Changing residue 338 in human factor IX from arginine to alanine causes an increase in catalytic activity," J. Biol. Chem. 273:12089-12094 (1998).

Chang et al., "Identification of functionally important residues of the epidermal growth factor-2 domain of factor IX by alanine-scanning mutagenesis. Resides Asn(89)-Gly(93) are critical for binding factor VIIIa," J. Biol. Chem. 277:25393-25399 (2002).

Chang et al., "Discontinuous residues of factor IX constitute a surface for binding the anti-factor IX monoclonal antibody A-5," Thromb. Res. 111(4-5):293-299 (2003).

Chang et al., "Glycosylation of the activation peptide of factor IX determines plasma half-life," J. Thromb. Haemost. 5(Supp. 2):abstract O-M-088, 2 pages (2007).

Chapman et al., "Therapeutic antibody fragments with prolonged in vivo half-lives," Nat. Biotechnol. 17(8):780-783 (1999).

Chen et al., "Model of a ternary complex between activated factor VII, tissue factor and factor IX," Thromb. Haemost. 88(1):74-82 (2002).

Cheung et al., "The binding of human factor IX to endothelial cells is mediated by residues 3-11," J. Biol. Chem. 267(29):20529-20531 (1992).

(56) References Cited

OTHER PUBLICATIONS

Cheung et al., "Identification of the endothelial cell binding site for factor IX," Proc. Natl. Acad. Sci. U.S.A. 93(20):11068-11073 (1996).
Craik et al., "Proteases as therapeutics," Biochem. J. 435:1-16 (2011).
De Boer et al., "The tac promoter: a functional hybrid derived from the trp and lac promoters," Proc. Natl. Acad. Sci. U.S.A. 80:21-25 (1983).
Derian et al., "Inhibitors of 2-ketoglutarate-dependent dioxygenases block aspartyl beta-hydroxylation of recombinant human factor IX in several mammalian expression systems," J. Biol. Chem. 264(12):6615-6618 (1989).
Devereux et al., "A comprehensive set of sequence analysis programs for the VAX," Nucleic Acids Res. 12(1):387-395 (1984).
Dickinson et al., "Identification of surface residues mediating tissue factor binding and catalytic function of the serine protease factor VIIa," Proc. Natl. Acad. Sci. U.S.A. 93(25):14379-14384 (1996).
Duffin et al., "Characterization of N-linked oligosaccharides by electrospray and tandem mass spectrometry," Anal. Chem. 64(13):1440-1448 (1992).
Elliott et al., "Structural requirements for additional N-linked carbohydrate on recombinant human erythropoietin," J. Biol. Chem. 279(16):16854-16862 (2004).
Evans et al., "Canine hemophilia B resulting from a point mutation with unusual consequences," Proc. Natl. Acad. Sci. U.S.A. 86(24):10095-10099 (1989).
Franchini et al., "Recombinant factor VIIa. An update on its clinical use," Thromb. Haemost. 93(6):1027-1035 (2005).
Fu et al., "A detailed structural characterization of ribonuclease B oligosaccharides by 1H NMR spectroscopy and mass spectrometry," Carbohydrate Res. 261(2):173-186 (1994).
Furmanek et al., "Protein C-mannosylation: facts and questions," Acta Biochim. Pol. 47(3):781-789 (2000).
Gardner et al., "The complete nucleotide sequence of an infectious clone of cauliflower mosaic virus by M13mp7 shotgun sequencing," Nucleic Acids Res. 9(12):2871-2888 (1981).
Geng et al., "Properties of a recombinant chimeric protein in which the gamma-carboxyglutamic acid and helical stack domains of human anti-coagulant protein C are replaced by those of human coagulation factor VII," Thromb. Haemostasis 77(5):926-933 (1997).
Gilbert et al., "Useful proteins from recombinant bacteria," Sci. Am. 242:74-94 (1980).
Gillece-Castro et al., "Oligosaccharide characterization with high-energy collision-induced dissociation mass spectrometry," Methods Enzymol. 193:689-712 (1990).
Gribskov et al., "Sigma factors from *E. coli, B. subtilis*, phage SP01, and phage T4 are homologous proteins," Nucleic Acids Res. 14(16):6745-6763 (1986).
Grosschedl et al., "Introduction of a μimmunoglobulin gene into the mouse germ line: specific expression in lymphoid cells and synthesis of functional antibody," Cell 38:647-658 (1984).
Guiotto et al., "An improved procedure for the synthesis of branched polyethylene glycols (PEGs) with the reporter dipeptide Met-betaAla for protein conjugation," Bioorg. Med. Chem. Lett. 12(2):177-180 (2002).
Hamaguchi et al., "The role of amino-terminal residues of the heavy chain of factor IXa in the binding of its cofactor, factor VIIIa," Blood 84(6):1837-1842 (1994).
Hammer et al., "Diversity of alpha-fetoprotein gene expression in mice is generated by a combination of separate enhancer elements," Science 235:53-58 (1987).
Hanahan, "Heritable formation of pancreatic β-cell tumours in transgenic mice expressing recombinant insulin/simian virus 40 oncogenes," Nature 315:115-122 (1985).
Harris et al., "Identification and structural analysis of the tetrasaccharide NeuAcα(2→6)Galβ(1→4)GlcNAcβ(1→3)Fucα1→O-linked to serine 61 of human factor IX," Biochem. 32(26):6539-6547 (1993).

Harvey et al., "Mutagenesis of the gama-carboxyglutamic acid domain of human factor VII to generate maximum enhancement of the membrane contact site," J. Biol. Chem. 278(10):8363-8369 (2003).
Herrera-Estrella et al., "Expression of chimaeric genes transferred into plant cells using a ti-plasmid-derived vector," Nature 303:209-213 (1984).
Herrera-Estrella et al., "Light-inducible and chloroplast-associated expression of a chimaeric gene introduced into *Nicotiana tabacum* using a Ti plasmid vector," Nature 310:115-120 (1984).
Hertzberg et al., "An Arg/Ser substitution in the second epidermal growth factor-like module of factor IX introduces an O-linked carbohydrate and markedly impairs activation by factor Xia and factor VIIIa/Tissue factor and catalytic efficiency of factor IXa," Blood 94:156-163 (1999).
Hoffman et al., "A cell-based model of hemostasis," Thromb. Haemost. 85:958-965 (2001).
Hopfner et al., "Converting blood coagulation factor Ixa into factor Xa: dramatic increase in amidolytic activity identifies important active site determinants," EMBO J. 16(22):6626-6635 (1997).
Hopfner et al., "Coagulation factor IXa: the relaxed conformation of Tyr99 blocks substrate binding," Structure Fold Des. 7(8):989-996 (1999).
Hsu et al., "The distinct roles that Gln-192 and Glu-217 of factor IX play in selectivity for macromolecular substrates and inhibitors," Biochem. 40:11261-11269 (2001).
Huddleston et al., "Collisional fragmentation of glycopeptides by electrospray ionization LC/MS and LC/MS/MS: methods for selective detection of glycopeptides in protein digests," Anal. Chem. 65(7):877-884 (1993).
IUPAC-IUB Commission on Biochemical Nomenclature, "A one-letter notation for amino acid sequences: tentative rules," J. Biol. Chem. 243(13):3557-3559 (1968).
IUPAC-IUB Commission on Biochemical Nomenclature, "Symbols for amino-acid derivatives and peptides: recommendations (1971)," Biochem. 11(9):1726-1732 (1972).
Izaguirre et al., "Residues of Tyr253 and Glu255 in strand 3 of beta-sheet C of antithrombin are key determinants of an exosite made accessible by heparin activation to promote rapid inhibition of actors Xa and IXa," J. Biol. Chem. 281(19):13424-13432 (2006).
Jay et al., "Construction of a general vector for efficient expression of mammalian proteins in bacteria: use of a synthetic ribosome binding site," Proc. Natl. Acad. Sci. U.S.A. 78:5543-5548 (1981).
Jin et al., "Creation of a mouse expressing defective human factor IX," Blood 104(6):1733-1739 (2004).
Kaufman, "Post-translational modifications required for coagulation factor secretion and function," Thromb. Haemost. 79(6):1068-1079 (1998).
Kay et al., "In vivo hepatic gene therapy: complete albeit transient correction of factor IX deficiency in hemophilia B dogs," Proc. Natl. Acad. Sci. U.S.A. 91(6):2353-2357 (1994).
Kelsey et al., "Species- and tissue-specific expression of human α1-antitrypsin in transgenic mice," Genes Dev. 1:161-171 (1987).
Ketner et al., "Efficient manipulation of the human adenovirus genome as an infectious yeast artificial chromosome clone," Proc. Natl. Acad. Sci. U.S.A. 91:6186-6190 (1994).
Khalilzadeh et al., "Process development for production of recombinant human interferon-γ expressed in *Escherichia coli*," J. Ind. Microbiol. Biotechnol. 31:63-69 (2004).
Kirchhofer et al., "The tissue factor region that interacts with substrates factor IX and factor X," Biochem. 39(25):7380-7387 (2000).
Koeberl et al., "Functionally important regions of the factor IX gene have a low rate of polymorphism and a high rate of mutation in the dinucleotide CpG," Am. J. Hum. Genet. 45:448-457 (1989).
Kolkman et al., "Insertion loop 256-268 in coagulation factor IX restricts enzymatice activity in the absence but not in the presence of factor VIII," Biochem. 39:7398-7405 (2000).
Kollias et al., "Regulated expression of human Aγ-, β-, and hybrid γβ-globin genes in transgenic mice: manipulation of the developmental expression patterns," Cell 46:89-94 (1986).
Krumlauf et al., "Developmental regulation of β-fetoprotein genes in transgenic mice," Mol. Cell. Biol. 5(7):1639-1648 (1985).

(56) References Cited

OTHER PUBLICATIONS

Kumar et al., "Elucidation of N-linked oligosaccharide structures of recombinant human factor VIII using fluorophore-assisted carbohydrate electrophoresis," Biotechnol. Appl. Biochem. 24(Pt. 3):207-216 (1996) [abstract only].

Kundu et al., "Targeted inactivation of the coagulation factor IX gene causes hemophilia B in mice," Blood 92(1):168-174 (1998).

Kurachi et al., "Regulatory mechanism of the factor IX gene," Thromb. Haemost. 73(3):333-339 (1995).

Lambert et al., "Reformulated BeneFix: efficacy and safety in previously treated patients with moderately severe to severe haemophilia B," Haemophilia 13:233-243 (2007).

Leder et al., "Consequences of widespread deregulation of the c-myc gene in transgenic mice: multiple neoplasms and normal development," Cell 45:485-495 (1986).

Liebman et al., "Immunoaffinity purification of factor IX (Christmas factor) by using conformation-specific antibodies directed against the factor IX-metal complex," Proc. Natl. Acad. Sci. U.S.A. 82:3879-3883 (1985).

Lin et al., "A coagulation factor IX-deficient mouse model for human hemophilia B," Blood 90(10):3962-3966 (1997).

Lin et al., "Binding of the Factor IX γ-carboxyglutamic acid domain to the vitamin K-dependent γ-glutamyl carboxylase active site induces an allosteric effect that may ensure processive carboxylation and regulate the release of carboxylate product," J. Biol. Chem. 279(8):6560-6566 (2004).

Lindenbaum et al., "A mammalian artificial chromosome engineering system (ACE System) applicable to biopharmaceutical protein production, transgenesis and gene-based cell therapy," Nucleic Acids Res. 32(21):e172 (2004).

MacDonald, "Expression of the pancreatic elastase I gene in transgenic mice," Hepatology 7(1):42S-51S (1987).

Madison et al., "Engineering factor VIIa molecules with improved therapeutic properties for treatment of patients with inhibitors," Haemophilia 16(Supp. 4):75 (2010).

Magram et al., "Developmental regulation of a cloned adult β-globin gene in transgenic mice," Nature 315:338-340 (1985).

Margaritis et al., "Novel therapeutic approach for hemophilia using gene delivery of an engineered secreted activated factor VII," J. Clin. Invest. 113(7):1025-1031 (2004).

Mason et al., "The hypogonadal mouse: reproductive functions restored by gene therapy," Science 234:1372-1378 (1986).

Mathur et al., "Interaction of factor IXa with factor VIIIa. Effects of protease domain Ca2+ binding site, proteolysis in the autolysis loop, phospholipid, and factor X," J. Biol. Chem. 272(37):23418-23426 (1997).

Maun et al., "Disulfide locked variants of factor VIIa with a restricted β-strand conformation have enhanced enzymatic activity," Protein Sci. 14:1171-1180 (2005).

Mauser et al., "A deletion mutation causes hemophilia B in Lhasa Apso dogs," Blood 88(9):3451-3455 (1996).

Mayfield et al., "Expression and assembly of a fully active antibody in algae," Proc. Natl. Acad. Sci. U.S.A. 100(2):438-442 (2003).

McVey et al., "Factor VII Deficiency and the FVII Mutation Database," Human Mutation 17(1):3-17 (2001).

Medzihradszky, "Characterization of site-specific N-glycosylation," from Post-translational Modifications of Proteins in Methods Mol. Biol. 446:293-316 (2008).

Melton et al., "Location of the platelet binding site in zymogen coagulation factor IX," Blood Coagul. Fibrin. 12(4):237-243 (2001).

Mikami et al., "A hybridoma-based in vitro translation system that efficiently synthesizes glycoproteins," J. Biotechnol. 127(1):65-78 (2006).

Misenheimer et al., "The heparin-binding exosite is critical to allosteric activation of factor Ixa in the intrinsic tenase complex: the role of arginine 165 and factor X," Biochem. 46(26):7886-7895 (2007).

Misenheimer et al., "The regulation of factor Ixa by supersulfated low molecular weight heparin," Biochem. 49:9997-10005 (2010).

Mitchell et al., "Practice guidelines for the molecular diagnosis of haemophilia B," Clinical Molecular Genetics Society, 6 pages (2003).

Morris et al., "Processive post-translational modification. Vitamin K-dependent carboxylation of a peptide substrate," J. Biol. Chem. 270(51):30491-30498 (1995).

Muneta et al., "Large-scale production of porcine mature interleukin-18 (IL-18) in silkworms using a hybrid baculovirus expression system," J. Vet. Med. Sci. 65(2):219-223 (2003).

Needleman et al., "A general method applicable to the search for similarities in the amino acid sequence of two proteins," J. Mol. Biol. 48:443-453 (1970).

Neels et al., "Activation of factor IX zymogen results in exposure of a binding site for low-density lipoprotein receptor-related protein," Blood 96(10):3459-3465 (2000).

Nelsestuen et al., "Elevated function of blood clotting factor VIIa mutants that have enhanced affinity for membranes," J. Biol. Chem. 276(43):39825-39831 (2001).

Neuenschwander et al., "Roles of the membrane-interactive regions of factor VIIa and tissue factor," J. Biol. Chem. 269(11):8007-8013 (1994).

Nishimura et al., "Identification of a disaccharide (Xyl-Glc) and a trisaccharide (Xyl2-Glc) O-glycosidically linked to a serine residue in the first epidermal growth factor-like domain of human factors VII and IX and protein Z and bovine protein Z," J. Biol. Chem. 264(34):20320-20325 (1989).

Olson et al., "Accelerating ability of synthetic oligosaccharides on antithrombin inhibition of proteinases of the clotting and fibrinolytic systems," Thromb. Haemost. 92:929-939 (2004).

Ornitz et al., "Elastase I promoter directs expression of human growth hormone and SV40 T antigen genes to pancreatic acinar cells in transgenic mice," Cold Spring Harbor Symp. Quant. Biol. 50:399-409 (1986).

Papac et al., "Techniques in Glycobiology," Townsend and Hotchkiss, eds., Marcel Decker, Inc., New York, pp. 33-52 (1997).

Payne et al., "Effect of soluble tissue factor on the kinetic mechanism of factor VIIa: enhancement of p-guanidino benzoate substrate hydrolysis," Biochem. 35:7100-7106 (1996).

Pearson et al., "Improved tools for biological sequence comparison," Proc. Natl. Acad. Sci. U.S.A. 85:2444-2448 (1988).

Persson et al. "Rational design of coagulation factor VIIa variants with substantially increased intrinsic activity," Proc. Natl. Acad. Sci. U.S.A. 98(24):13583-13588 (2001).

Persson et al., "The N-terminal epidermal growth factor-like domain of coagulation factor IX," J. Biol. Chem. 277(38):35616-35624 (2002).

Petersen et al., "Zymogen-activation kinetics. Modulatory effects of trans-4-(aminomethyl)cyclohexane-l-carboxylic acid and poly-D-lysine on plasminogen activation," Biochem. J. 225(1):149-158 (1985).

Pham et al., "Large-scale transient transfection of serum-free suspension-growing HEK293 EBNAI cells: peptone additives improve cell growth and transfection efficiency," Biotechnol. Bioeng. 84:332-342 (2003).

Pinkert et al., "An albumin enhancer located 10 kb upstream functions along with its promoter to direct efficient, liver-specific expression in transgenic mice," Gene Dev. 1:268-276 (1987).

Pipe, S., "The promise and challenges of bioengineered recombinant clotting factors," J. Thromb. Haemost. 3:1692-1701 (2005).

Platis et al., "High yield expression, refolding, and characterization of recombinant interferon α2/α8 hybrids in *Escherichia coli*," Protein Exp. Purif. 31(2):222-230 (2003).

Ploug et al., "Glycosylation profile of a recombinant urokinase-type plasminogen activator receptor expressed in Chinese hamster ovary cells," J. Biol. Chem. 273(22):13933-13943 (1998).

Przysiecki et al., "Occurrence of β-hydroxylated asparagine residues in non-vitamin K-dependent proteins containing epidermal growth factor-like domains," Proc. Natl. Acad. Sci. U.S.A. 84:7856-7860 (1987).

Rao et al., "The structure of a Ca(2+)-binding epidermal growth factor-like domain: its role in protein-protein interactions," Cell 82(1):131-141 (1995).

(56) References Cited

OTHER PUBLICATIONS

Readhead et al., "Expression of a myelin basic protein gene in transgenic shiverer mice: correction of the dysmyelinating phenotype," Cell 48:703-712 (1987).
Roberts et al., "Chemistry for peptide and protein PEGylation," Adv. Drug Deliv. Rev. 54(4):459-476 (2002).
Rohlena et al., "Residues Phe342-Asn346 of activated coagulation factor IX contribute to the interaction with low density lipoprotein receptor-related protein," J. Biol. Chem. 278(11):9394-9401 (2003).
Ruf, "Factor VIIa residue Arg290 is required for efficient activation of the macromolecular substrate factor X," Biochem. 33:11631-11636 (1994).
Ruggeri, "Platelets in atherothrombosis," Nat. Med. 8:1227-1234 (2002).
Sabatino et al., "Novel hemophilia B mouse models exhibiting a range of mutations in the factor IX gene," Blood 104(9):2767-2774 (2004).
Sato, "Enzymatic procedure for site-specific pegylation of proteins," Adv. Drug Deliv. Rev. 54(4):487-504 (2002).
Savage et al., "Mechanisms of platelet aggregation," Curr. Opin. Hematol. 8:270-276 (2001).
Schmidt et al., "Structure-function relationships in factor IX and factor IXa," Trends Cardiovasc. Med. 13(1):39-45 (2003).
Schuettrumpf et al., "Factor IX variants improve gene therapy efficacy for hemophilia B," Blood 105(6):2316-2323 (2005).
Schwartz, "Factor IX overview," Medscape Reference, Published on Feb. 27, 2012 [online] [retrieved on Jul. 5, 2012] Retrieved from: <URL:emedicine.medscape.com/article/199088-overview [106 pages].
Schwartz and Dayhoff, "Matrices for detecting distant relationships," in Atlas of Protein Seuqence and Structure, National Biomedical Research Foundation, pp. 353-358 (1979).
Schwarz et al., "A combined method for producing homogeneous glycoproteins with eukaryotic N-glycosylation," Nat. Chem. Biol. 6(4):264-266 (2010).
Shah et al., "Manipulation of the membrane binding site of vitamin K-dependent proteins: enhanced biological function of human factor VII," Proc. Natl. Acad. Sci. U.S.A. 95(8):4229-4234 (1998).
Shani, "Tissue-specific expression of rat myosin light-chain 2 gene in transgenic mice," Nature 314:283-286 (1985).
Shapiro et al., "The safety and efficacy of recombinant human blood coagulation factor IX in previously untreated patients with severe or moderately severe hemophilia B," Blood 105(2):518-525 (2005).
Sheehan et al., "Depolymerized holothurian glycosaminoglycan and heparin inhibit the intrinsic tenase complex by a common antithrombin-independent mechanism," Blood 107(10):3876-3882 (2006).
Sheffield et al., "Effects of genetic fusion of factor IX to albumin on in vivo clearance in mice and rabbits," Br. J. Haematol. 126(4):565-573 (2004).
Shikamoto et al., "Crystal structure of Mg2+- and Ca2+-bound Gla domain of factor IX complexed with binding protein," J. Biol. Chem. 278(26):24090-24094 (2003).
Sichler et al., "Physiological fIXa activation involves a cooperative conformational rearrangement of the 99-loop," J. Biol. Chem. 278(6):4121-4126 (2003).
Sinclair et al., "Glycoengineering: the effect of glycosylation on the properties of therapeutic proteins," J. Pharm. Sci. 94(8):1626-1635 (2005).
Skoko et al., "Expression and characterization of human interferon-β1 in the methylotrophic yeast *Pichia pastoris*," Biotechnol. Appl. Biochem. 38:257-265 (2003).
Smith and Waterman, "Comparison of biosequences," Adv. Appl. Math. 2:482-489 (1981).
Sola et al., "Effects of glycosylation on the stability of protein pharmaceuticals," J. Pharm. Sci. 98(4):1223-1245 (2009).
Srour et al., "Regulation of human factor IX expression using doxycycline-inducible gene expression system," Thromb. Haemost. 90:398-405 (2003).
Stenina et al., "Tethered processivity of the vitamin K-dependent carboxylase: factor IX is efficiently modified in a mechanism which distinguishes Gla's from Glu's and which accounts for comprehensive carboxylation in vivo," Biochem. 40:10301-10309 (2001).
Sturzebecher et al., "Dramatic enhancement of the catalytic activity of coagulation factor IXa by alcohols," FEBS Lett. 412(2):295-300 (1997).
Sun et al., "Gla domain-mutated human protein C exhibiting enhanced anticoagulant activity and increased phospholipid binding," Blood 101:2277-2284 (2003).
Sunnerhagen et al., "The effect of aspartate hydroxylation on calcium binding to epidermal growth factor-like modules in coagulation factors IX and X," J. Biol. Chem. 268(31):23339-23341 (1993).
Sutton et al., "Site-specific characterization of glycoprotein carbohydrates by exoglycosidase digestion and laser desorption mass spectrometry," Anal. Biochem. 218(1):34-46 (1994).
Swift et al., "Tissue-specific expression of the rat pancreatic elastase I gene in transgenic mice," Cell 38:639-646 (1984).
Townsend et al., "Analysis of glycoprotein oligosaccharides using high-pH anion exchange chromatography," Glycobiol. 1(2):139-147 (1991).
Tyagarajan et al., "Exoglycosidase purity and linkage specificity: assessment using oligosaccharide substrates and high-pH anion-exchange chromatography with pulsed amperometric detection," Glycobiol. 6(1):83-93 (1996).
Wagner et al., "Nucleotide sequence of the thymidine kinase gene of herpes simplex virus type I," Proc. Natl. Acad. Sci. U.S.A. 78:1441-1445 (1981).
Wajih et al., "Increased production of functional recombinant human clotting factor IX by baby hamster kidney cells engineered to overexpress VKORC1, the vitamin K 2,3-epoxide-reducing enzyme of the vitamin K cycle," J. Biol. Chem. 280(36):31603-31607 (2005).
Wang et al., "A factor IX-deficient mouse model for hemophilia B gene therapy," Proc. Natl. Acad. Sci. U.S.A. 94(21):11563-11566 (1997).
Watson et al., "Molecular Biology of the Gene," 4th Edition, The Benjamin/Cummings Publ. Co., p. 224 (1987).
Watzlawick et al., "Structure of the N- and O-glycans of the A-chain of human plasma alpha 2HS-glycoprotein as deduced from the chemical compositions of the derivatives prepared by stepwise degradation with exoglycosidases," Biochem. 31(48):12198-12203 (1992).
Weiner et al., "Liposome-collagen gel matrix: a novel sustained drug delivery system," J. Pharm. Sci. 74(9):922-925 (1985).
White et al., "Recombinant factor IX," Thromb. Haemost. 78(1):261-265 (1997).
Wu et al., "Hemophilia B with mutations at glycine-48 of factor IX exhibited delayed activation by the factor VIIa-tissue factor complex," Thromb. Haemost. 84:626-634 (2000).
Yamamoto et al., "Identification of a functional promoter in the long terminal repeat of rous sarcoma virus," Cell 22:787-797 (1980).
Yang et al., "Localization of the heparin binding exosite of factor IXa," J. Biol. Chem. 277(52):50756-50760 (2002).
Yang et al., "Contribution of basic residues of the autolysis loop to the substrate and inhibitor specificity of factor IXa," J. Biol. Chem. 278(27):25032-25038 (2003).
Yuan et al., "The factor IXa heparin-binding exosite is a cofactor interactive site: mechanism for antithrombin-independent inhibition of intrinsic tenase by heparin," 44:3615-3625 (2005).
Zambaux et al., "Covalent fixation of soluble derivatized dextrans to model proteins in low-concentration medium: application to factor IX and protein C," J. Protein Chem. 17(3):279-284 (1998).
Zhong et al., "The N-terminal epidermal growth factor-like domain in factor IX and factor X represents an important recognition motif for binding to tissue factor," J. Biol. Chem. 277(5):3622-3631 (2002).
Partial International Search Report, issued Jan. 27, 2012, in connection with corresponding International Patent Application No. PCT/US2011/059233, 5 pages.
International Search Report and Written Opinion, issued Mar. 26, 2012, in connection with corresponding International Patent Application No. PCT/US2011/059233, 18 pages.
Response to the International Search Report and Written Opinion, submitted Sep. 3, 2012, in connection with corresponding International Patent Application No. PCT/US2011/059233, 56 pages.
First Examination Report, issued Oct. 30, 2013, in connection with corresponding New Zealand Patent Application No. 609959 (2 pages).

\* cited by examiner

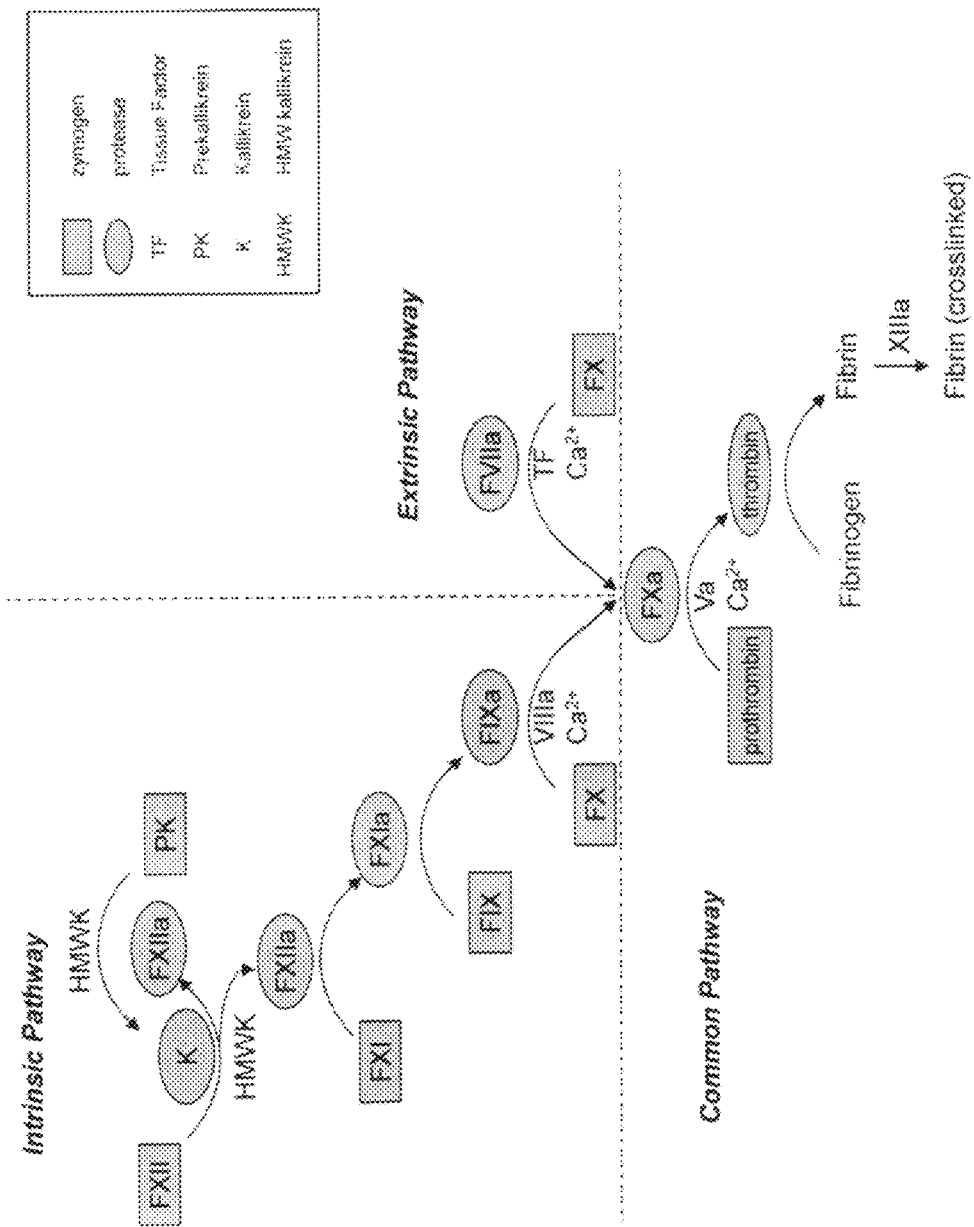
Figure 1. Coagulation cascade

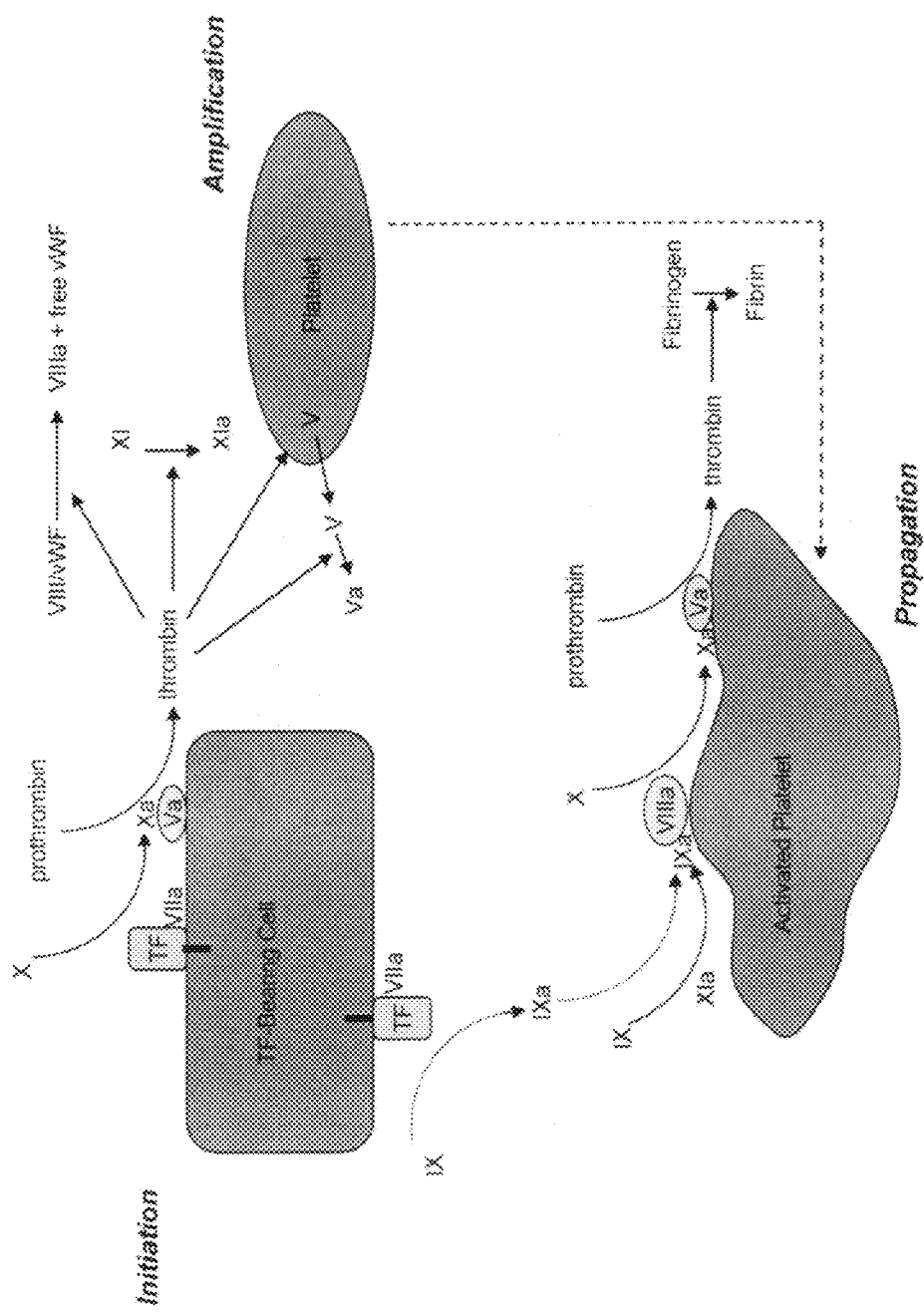

| SEQ ID NO:20 | ---------------------------------------------YNSGKLEEFVQGNL | 14 |
|---|---|---|
| SEQ ID NO:325 | MQRVNMIMAESPGLITICLLGYLLSAECTVFLDHENANKILNRPKRYNSGKLEEFVQGNL | 60 |
| SEQ ID NO:2 | MQRVNMIMAESPGLITICLLGYLLSAECTVFLDHENANKILNRPKRYNSGKLEEFVQGNL | 60 |
| SEQ ID NO:3 | ---------------------------------------------YNSGKLEEFVQGNL | 14 |
| SEQ ID NO:4 | MQRVNMIMAESPGLITICLLGYLLSAECTVFLDHENANKILNRPKRYNSGKLEEFVQGNL | 60 |
| SEQ ID NO:267 | ---------------------------------------------YNSGKLEEFVQGNL | 14 |
| SEQ ID NO:366 | ---------------------------------------------YNSGKLEEFVQGNL | 14 |
| SEQ ID NO:360 | ---------------------------------------------YNSGKLEEFVQGNL | 14 |
| SEQ ID NO:406 | ---------------------------------------------YNSGKLEEFVQGNL | 14 |
| SEQ ID NO:346 | ---------------------------------------------YNSGKLEEFVQGNL | 14 |
| SEQ ID NO:172 | ---------------------------------------------YNSGKLEEFVQGNL | 14 |
| SEQ ID NO:347 | ---------------------------------------------YNSGKLEEFVQGNL | 14 |
| SEQ ID NO:365 | ---------------------------------------------YNSGKLEEFVQGNL | 14 |
| 7,700,734 | MQRVNMIMAESPSLITICLLGYLLSAECTVFLDHENANKILNRPKRYNSGKLEEFVQGNL | 60 |
| 7,125,841 | MQRVNMIMAESPGLITICLLGYLLSAECTVFLDHENANKILNRPKRYNSGKLEEFVQGNL | 60 |
| SEQ ID NO:5 | ---------------------------------------------YNSGKLEEFVQGNL | 14 |
| SEQ ID NO:14 | ---------------------------------------------YNSGKLEEFVRGNL | 14 |
| | ************:** | |

| SEQ ID NO:20 | ERECMEEKCSFEEAREVFENTERTTEFWKQYVDGDQCESNPCLNGGSCKDDINSYECWCP | 74 |
|---|---|---|
| SEQ ID NO:325 | ERECMEEKCSFEEAREVFENTERTTEFWKQYVDGDQCESNPCLNGGSCKDDINSYECWCP | 120 |
| SEQ ID NO:2 | ERECMEEKCSFEEAREVFENTERTTEFWKQYVDGDQCESNPCLNGGSCKDDINSYECWCP | 120 |
| SEQ ID NO:3 | ERECMEEKCSFEEAREVFENTERTTEFWKQYVDGDQCESNPCLNGGSCKDDINSYECWCP | 74 |
| SEQ ID NO:4 | ERECMEEKCSFEEAREVFENTERTTEFWKQYVDGDQCESNPCLNGGSCKDDINSYECWCP | 120 |
| SEQ ID NO:267 | ERECMEEKCSFEEAREVFENTERTTEFWKQYVDGDQCESNPCLNGGSCKDDINSYECWCP | 74 |
| SEQ ID NO:366 | ERECMEEKCSFEEAREVFENTERTTEFWKQYVDGDQCESNPCLNGGSCKDDINSYECWCP | 74 |
| SEQ ID NO:360 | ERECMEEKCSFEEAREVFENTERTTEFWKQYVDGDQCESNPCLNGGSCKDDINSYECWCP | 74 |
| SEQ ID NO:406 | ERECMEEKCSFEEAREVFENTERTTEFWKQYVDGDQCESNPCLNGGSCKDDINSYECWCP | 74 |
| SEQ ID NO:346 | ERECMEEKCSFEEAREVFENTERTTEFWKQYVDGDQCESNPCLNGGSCKDDINSYECWCP | 74 |
| SEQ ID NO:172 | ERECMEEKCSFEEAREVFENTERTTEFWKQYVDGDQCESNPCLNGGSCKDDINSYECWCP | 74 |
| SEQ ID NO:347 | ERECMEEKCSFEEAREVFENTERTTEFWKQYVDGDQCESNPCLNGGSCKDDINSYECWCP | 74 |
| SEQ ID NO:365 | ERECMEEKCSFEEAREVFENTEKITEFWKQYVDGDQCESNPCLNGGSCKDDINSYECWCP | 74 |
| 7,700,734 | ERECMEEKCSFEEPREVFENTEKTTEFWKQYVDGDQCESNPCLNGGSCKDDINSYECWCP | 120 |
| 7,125,841 | ERECKEEKCNFEEAREVFENTEKTTEFWKQYVDGDQCESNPCLNGGMCKDDINSYECWCP | 120 |
| SEQ ID NO:5 | ERECMEEKCSFEEAREVFENTERTTEFWKQYVDGDQCESNPCLNGGSCKDDINSYECWCP | 74 |
| SEQ ID NO:14 | ERECMEEKCSFEEAREVFENTERTTEFWKQYVDGDQCESNPCLNGGSCKDDINSYECWCQ | 74 |
| | **:*..**********************.************* | |

FIG. 3A

| | | |
|---|---|---|
| SEQ ID NO:20 | FGFEGKNCELDVTCNIKNGRCEQFCKNSADNKVVCSCTEGYRLAENQKSCEPAVPFPCGR | 134 |
| SEQ ID NO:325 | FGFEGKNCELDVTCNIKNGRCEQFCKNSADNKVVCSCTEGYRLAENQKSCEPAVPFPCGR | 180 |
| SEQ ID NO:2 | FGFEGKNCELDVTCNIKNGRCEQFCKNSADNKVVCSCTEGYRLAENQKSCEPAVPFPCGR | 180 |
| SEQ ID NO:3 | FGFEGKNCELDVTCNIKNGRCEQFCKNSADNKVVCSCTEGYRLAENQKSCEPAVPFPCGR | 134 |
| SEQ ID NO:4 | FGFEGKNCELDVTCNIKNGRCEQFCKNSADNKVVCSCTEGYRLAENQKSCEPAVPFPCGR | 180 |
| SEQ ID NO:267 | FGFEGKNCELDVTCNIKNGRCEQFCKNSADNKVVCSCTEGYRLAENQKSCEPAVPFPCGR | 134 |
| SEQ ID NO:366 | FGFEGKNCELDVTCNIKNGRCEQFCKNSADNKVVCSCTEGYRLAENQKSCEPAVPFPCGR | 134 |
| SEQ ID NO:360 | FGFEGKNCELDVTCNIKNGRCEQFCKNSADNKVVCSCTEGYRLAENQKSCEPAVPFPCGR | 134 |
| SEQ ID NO:406 | FGFEGKNCELDVTCNIKNGRCEQFCKNSADNKVVCSCTEGYRLAENQKSCEPAVPFPCGR | 134 |
| SEQ ID NO:346 | FGFEGKNCELDVTCNIKNGRCEQFCKNSADNKVVCSCTEGYRLAENQKSCEPAVPFPCGR | 134 |
| SEQ ID NO:172 | FGFEGKNCELDVTCNIKNGRCEQFCKNSADNKVVCSCTEGYRLAENQKSCEPAVPFPCGR | 134 |
| SEQ ID NO:347 | FGFEGKNCELDVTCNIKNGRCEQFCKNSADNKVVCSCTEGYRLAENQKSCEPAVPFPCGR | 134 |
| SEQ ID NO:365 | FGFEGKNCELDATCNIKNGRCEQFCKNSADNKVVCSCTEGYRLAENQKSCEPAVPFPCGR | 134 |
| 7,700,734 | FGFEGKNCELDVTCNIKNGRCEQFCKNTADNKVVCSCTEGYRLAENQRSCEPAVPFPCGR | 180 |
| 7,125,841 | FGFEGTNCELDATCSIKNGRCKQFCKRDTDNKVVCSCTDGYRLAEDQKSCEPAVPFPCGR | 180 |
| SEQ ID NO:5 | AGFEGTNCELDATCSIKNGRCKQFCKRDTDNKVVCSCTDGYRLAEDQKSCEPAVPFPCGR | 134 |
| SEQ ID NO:14 | **:*.***:*:* . : *** .:**:********* | |

| | | |
|---|---|---|
| SEQ ID NO:20 | VSVSQTS-KLTRAEAVFPDVDYVNSTEAETILDNITQSTQSFNDFTRVVGGEDAKPGQFP | 193 |
| SEQ ID NO:325 | VSVSQTS-KLTRAEAVFPDVDYVNSTEAETILDNITQSTQSFNDFTRVVGGEDAKPGQFP | 239 |
| SEQ ID NO:2 | VSVSQTS-KLTRAETVFPDVDYVNSTEAETILDNITQSTQSFNDFTRVVGGEDAKPGQFP | 239 |
| SEQ ID NO:3 | VSVSQTS-KLTRAETVFPDVDYVNSTEAETILDNITQSTQSFNDFTRVVGGEDAKPGQFP | 193 |
| SEQ ID NO:4 | VSVSQTS-KLTRAETVFPDVDYVNSTEAETILDNITQSTQSFNDFTRVVGGEDAKPGQFP | 239 |
| SEQ ID NO:267 | VSVSQTS-KLTRAETVFPDVDYVNSTEAETILDNITQSTQSFNDFTRVVGGEDAKPGQFP | 193 |
| SEQ ID NO:366 | VSVSQTS-KLTRAETVFPDVDYVNSTEAETILDNITQSTQSFNDFTRVVGGEDAKPGQFP | 193 |
| SEQ ID NO:360 | VSVSQTS-KLTRAETVFPDVDYVNSTEAETILDNITQSTQSFNDFTRVVGGEDAKPGQFP | 193 |
| SEQ ID NO:406 | VSVSQTS-KLTRAETVFPDVFVNSTEAETILDNITQSTQSFNDFTRVVGGEDAKPGQFP | 193 |
| SEQ ID NO:346 | VSVSQTS-KLTRAETVFPDVDYVNSTEAETILDNITQSTQSFNDFTRVVGGEDAKPGQFP | 193 |
| SEQ ID NO:172 | VSVSQTS-KLTRAETVFPDVDYVNSTEAETILDNITQSTQSFNDFTRVVGGEDAKPGQFP | 193 |
| SEQ ID NO:347 | VSVSQTS-KLTRAETVFPDVDYVNSTEAETILDNITQSTQSFNDFTRVVGGEDAKPGQFP | 193 |
| SEQ ID NO:365 | VSVSQTS-KLTRAETVFPDVDYVNPTEAETILDNITQGTQSFNDFTRVVGGEDAKPGQFP | 193 |
| 7,700,734 | VSVSQTS-KLTRAETVFPDVEYVNSTEAETILDNITQSTQSFNDFTRVVGGEDAKPGQFP | 239 |
| 7,125,841 | VSVSQTS-TLTRAETIFSNTNYENSSEAEIIWDNVTQSNQSFDEFSRVVGGEDAERGQFP | 239 |
| SEQ ID NO:5 | VSVSHISKKLTRAEIIFSNTNYENSSEAEIIWDNVTQSNQSFDEFSRVVGGEDAERGQFP | 194 |
| SEQ ID NO:14 | **** : . * . :**** .:: . :* * ** * * . * . : * . ******** * **** | |

FIG. 3B

```
SEQ ID NO:20      WQVVLNGKVDAFCGGSIVNEKWIVTAAHCVETGVKITVVAGEHNIEETEHTEQKRNVIR-  252
SEQ ID NO:325     WQVVLNGKVDAFCGGSIVNEKWIVTAAHCVETGVKITVVAGEHNIEETEHTEQKRNVIR-  298
SEQ ID NO:2       WQVVLNGKVDAFCGGSIVNEKWIVTAAHCVETGVKITVVAGEHNIEETEHTEQKRNVIR-  298
SEQ ID NO:3       WQVVLNGKVDAFCGGSIVNEKWIVTAAHCVDTGVKITVVAGEHNIEETEHTEQKRNVIR-  252
SEQ ID NO:4       WQVVLNGKVDAFCGGSIVNEKWIVTAAHCVETGVKITVVAGEHNIEETEHTEQKRNVIR-  298
SEQ ID NO:267     WQVVLNGKVDAFCGGSIVNEKWIVTAAHCVETGVKITVVAGEHNIEETEHTEQKRNVIR-  252
SEQ ID NO:366     WQVVLNGKVDAFCGGSIVNEKWIVTAAHCVETGVNITVVAGEHNIEETEHTEQNRSVIR-  252
SEQ ID NO:360     WQVVLNGKVDAFCGGSIVNEKWIVTAAHCVETGVNITVVAGEHNIEETEHTEQNRSVIR-  252
SEQ ID NO:406     WQVVLNGKVDAFCGGSIVNEKWIVTAAHCVETGVKITVVAGEHNIEETEHTEQKRNVIR-  252
SEQ ID NO:346     WQVVLNGKVDAFCGGSIVNEKWIVTAAHCVETGVKITVVAGEHNIEETEHTEQKRNVIR-  252
SEQ ID NO:172     WQVVLNGKVDAFCGGSIVNEKWIVTAAHCVETGVKITVVAGEHNIEETEHTEQKRNVIR-  252
SEQ ID NO:347     WQVVLNGKVDAFCGGSIVNEKWVVTAAHCVETDAKITVVAGEHNIEETEHTEQKRNVSR-  252
SEQ ID NO:365     WQVVLNGKVDAFCGGSIVNEKWIVTAAHCVETGVKITVVAGEHNIEETEHTEQKRNVIR-  252
7,700,734         WQVVLNGKVDAFCGGSIVNEKWIVTAAHCIKPGVKITVVAGEHNTEKPEPTEQKRNVIRA  299
7,125,841         WQVLLHGEIAAFCGGSIVNEKWVVTAAHCVETDAKITVVAGEHNIEETEHTEQKRNVIR-  298
SEQ ID NO:5       WQVVLNGKVDAFCGGSIVNEKWIVTAAHCVETGVKITVVAGEHNIEETEHTEQKRNVIR-  252
SEQ ID NO:14      *****                                            *  *    * *  253
                  *  : *: *   *****************:********: :  **********:* .*.*

SEQ ID NO:20      IIPHHNYNAAINKYNHDIALLELDEPLVLNSYVTPICIADKEYTNIFLKFGSGYVSGWGR  312
SEQ ID NO:325     IIPHHNYNAAINKYNHDIALLELDEPLVLNSYVTPICIADKEYTNIFLKFGSGYVSGWGR  358
SEQ ID NO:2       IIPHHNYNAAINKYNHDIALLELDEPLVLNSYVTPICIADKEYTNIFLKFGSGYVSGWGR  358
SEQ ID NO:3       IIPHHNYNAAINKYNHDIALLELDEPLVLNSYVTPICIADKEYTNIFLKFGSGYVSGWGR  312
SEQ ID NO:4       IIPHHNYNAAINKYNHDIALLELDEPLVLNSYVTPICIADKEYTNIFLKFGSGYVSGWGR  358
SEQ ID NO:267     IIPHHNYNAAINKYNHDIALLELDEPLVLNSYVTPICIADKEYTNIFLKFGSGYVSGWGR  312
SEQ ID NO:366     IIPHHNYNAAINKYNHDIALLELDEPLVLNSYVTPICIADKEYTNIFLKFGSGYVSGWGR  312
SEQ ID NO:360     IIPHHNYNAAINKYNHDIALLELDEPLVLNSYVTPICIADKEYTNIFLKFGSGYVSGWGR  312
SEQ ID NO:406     IIPHHNYNAAINKYNHDIALLELDEPLVLNSYVTPICIADKEYTNIFLKFGSGYVSGWGR  312
SEQ ID NO:346     IIPHHNYNAAINKYNHDIALLELDEPLVLNSYVTPICIADKEYTNIFLKFGSGYVSGWGR  312
SEQ ID NO:172     IIPHHNYNAAINKYNHDIALLELDEPLVLNSYVTPICIADKEYTNIFLKFGSGYVSGWGR  312
SEQ ID NO:347     IIPHHNYNAAINKYNHDIALLELDEPLVLNSYVTPICIADKEYTNIFLKFGSGYVSGWGR  312
SEQ ID NO:365     IIPHHNYNAAINKYNHDIALLELDAPLVLNSYVTPICIADKEYTNIFLKFGSGYVSGWGR  312
7,700,734         IIPHHNYNAAINKYNHDIALLELDEPLVLNSYVTPICIADKEYTNIFLKFGSGYVSGWGR  359
7,125,841         IIPHHNYNATINKYNHDIALLELDEPLELNSYVTPICIADKEYTNIFLKFGSGYVSGWGR  358
SEQ ID NO:5       IIPHHNYNAAINKYNHDIALLELDEPLVLNSYVTPICIADKEYTNIFLKFGSGYVSGWAR  312
SEQ ID NO:14      AIPYHSYNASINKYSHDIALLELDEPLELNSYVTPICIADRDYTNIFSKFGYGYVSGWGK  313
                  .**::. ***:.***.*******  **: ********* : **** **** ******.:

MODIFIED FACTOR IX POLYPEPTIDES AND USES THEREOF

RELATED APPLICATIONS

Benefit of priority is claimed to U.S. Provisional Application Ser. No. 61/456,298, entitled "MODIFIED FACTOR IX POLYPEPTIDES AND USES THEREOF," filed on Nov. 3, 2010, to Edwin Madison, Christopher Thanos and Grant Ellsworth Blouse.

This application also is related to corresponding International Application No. PCT/US11/59233, filed the same day herewith, entitled "MODIFIED FACTOR IX POLYPEPTIDES AND USES THEREOF," which also claims priority to U.S. Provisional Application Ser. No. 61/456,298.

The subject matter of each of the above-referenced applications is incorporated by reference in its entirety.

INCORPORATION BY REFERENCE OF SEQUENCE LISTING PROVIDED ON COMPACT DISCS

An electronic version on compact disc (CD-R) of the Sequence Listing is filed herewith in duplicate (labeled Copy #1 and Copy #2), the contents of which are incorporated by reference in their entirety. The computer-readable file on each of the aforementioned compact discs, created on Nov. 3, 2011, is identical, 1.07 megabytes in size, and titled 4918SEQ.001.txt.

FIELD OF INVENTION

Provided are modified FIX polypeptides. The FIX polypeptides are modified to exhibit improved properties, such as increased coagulant activity compared to unmodified FIX polypeptides. Also provided are nucleic acid molecules encoding these polypeptides, and methods of using the modified FIX polypeptides.

BACKGROUND

Recombinantly produced Factor IX (FIX) polypeptides have been approved for treatment of hemophilia, in particular hemophilia B. Also of therapeutic interest are FIX polypeptides that exhibit anticoagulant activities useful in the treatment of thrombolytic diseases. Hence, FIX, like other coagulation factors, are important therapeutic agents for procoagulant and anticoagulation therapies. There is a need for FIX polypeptides for therapeutic use. Therefore, among the objects herein, it is an object to provide modified FIX polypeptides that are designed to have improved therapeutic properties.

SUMMARY

Provided are modified FIX polypeptides. The modified FIX polypeptides provided have improved procoagulant therapeutic properties compared to an unmodified FIX polypeptide. For example, among the modified FIX polypeptides provided herein are those that exhibit increased coagulant activity, increased catalytic activity, increased resistance to AT-III, heparin and/or the AT-III/heparin complex, and/or improved pharmacokinetic properties, such as i) decreased clearance, ii) altered (e.g. increased or decreased) volume of distribution, iii) enhanced in vivo recovery, iv) enhanced total protein exposure in vivo (i.e., AUC), v) increased serum half-life ($\alpha$-, $\beta$-, and/or $\gamma$-phase), and/or vi) increased mean resonance time (MRT). In some examples, the improved pharmacokinetic properties are a result of increased glycosylation and/or decreased binding to the low-density lipoprotein receptor-related protein (LRP). Also provided are nucleic acids encoding the modified FIX polypeptides and methods of using the modified FIX polypeptides, such as for treatment of bleeding disorders.

Provided herein are modified FIX polypeptides containing an amino acid replacement in an unmodified FIX polypeptide, wherein the amino acid replacement can be one or more of replacement of tyrosine (Y) at amino acid residue R318 (R318Y), R318E, R318F, R318W, R318D, R318I, R318K, R318L, R318M, R318S, R318V, S61A, S61C, S61D, S61E, S61F, S61G, S61I, S61K, S61L, S61P, S61R, S61V, S61W, S61Y, D64A, D64C, D64F, D64H, D64I, D64L, D64M, D64P, D64R, D64S, D64T, D64W, Y155F, Y155L, N157D, N157E, N157F, N157I, N157K, N157L, N157M, N157R, N157V, N157W, N157Y, S158A, S158D, S158E, S158F, S158G, S158I, S158K, S158L, S158M, S158R, S158V, S158W, S158Y, N167D, N167Q, N167E, N167F, N167G, N167H, N167I, N167K, N167L, N167M, N167P, N167R, N167V, N167W, N167Y, T169A, T169D, T169E, T169F, T169S, T169V, T169W, T169Y, T172A, T172D, T172E, T172F, T172G, T172I, T172K, T172L, T172M, T172P, T172R, T172S, T172V, T172W, T172Y, D203M, D203Y, D203F, D203H, D203I, D203K, D203L, D203R, D203V, D203W, A204M, A204Y, A204F, A204I, A204W, E239S, E239R, E239K, E239D, E239F, E239I, E239L, E239M, E239T, E239V, E239W, E239Y, H257F, H257E, H257D, H257I, H257K, H257L, H257M, H257Q, H257R, H257V, H257W, R312Y, R312L, R312C, R312D, R312E, R312F, R312I, R312K, R312M, R312P, R312S, R312T, R312V, R312W, K316M, K316D, K316F, K316H, K316I, K316L, K316R, K316V, K316W, K316Y, F342I, F342D, F342E, F342K, F342L, F342M, F342S, F342T, F342V, F342W, F342Y, T343R, T343E, T343D, T343F, T343I, T343K, T343L, T343M, T343S, T343V, T343W, T343Y, N346Y, N346E, N346F, N346H, N346I, N346K, N346L, N346M, N346Q, N346R, N346V, N346W, K400E, K400C, K400D, K400F, K400G, K400L, K400M, K400P, K400S, K400T, K400V, K400Y, R403D, R403F, R403I, R403K, R403L, R403M, R403S, R403V, R403Y, E410D, E410S, E410A, E410F, E410G, E410I, E410K, E410L, E410M, E410P, E410R, E410T, E410V, E410W, E410Y, T412A, T412V, T412C, T412D, T412E, T412F, T412G, T412I, T412M, T412P, T412W or T412Y in a mature FIX polypeptide having a sequence set forth in SEQ ID NO:3, or the same replacement at a corresponding amino acid residue in an unmodified FIX polypeptide, wherein corresponding amino acid residues are identified by alignment of the unmodified FIX polypeptide with the polypeptide of SEQ ID NO:3; and provided that the modified FIX polypeptide does not contain the modifications F342I/T343R/Y345T. In particular, provided herein are modified FIX polypeptides containing amino acid replacements R318Y/R338E/R403E/E410N, R318Y/R338E/T343R/R403E/E410N, R318Y/R338E/T343R/E410N, Y155F/R318Y/R338E/T343R/R403E, Y155F/K228N/K247N/N249S/R318Y/R338E/T343R/R403E/E410N, Y155F/K247N/N249S/R318Y/R338E/T343R/R403E, K247N/N249S/R318Y/R338E/T343R/R403E, R318Y/R338E/T343R, Y155F/K247N/N249S/R318Y/R338E/T343R, K228N/R318Y/R338E/T343R/R403E/E410N, K228N/K247N/N249S/R318Y/R338E/T343R/R403E, R318Y/R338E/T343R/R403E/E410S, Y155F/K247N/N249S/R318Y/R338E, K247N/N249S/R318Y/R338E/T343R, R318Y/T343R/E410N, Y155F/R318Y/R338E/

R403E, Y155F/R338E/T343R/R403E/E410N, Y155F/ K247N/N249S/R338E/R403E/E410N, K247N/N249S/ R338E/T343R/R403E/E410N or R338E/T343R/E410N.

Among the modified FIX polypeptides provided herein are those containing two amino acid replacements in unmodified FIX polypeptide, wherein the first amino acid replacement is at a position corresponding to a position selected from among 53, 61, 64, 85, 103, 104, 105, 106, 108, 155, 158, 159, 167, 169, 172, 179, 202, 203, 204, 205, 228, 239, 241, 243, 247, 249, 251, 257, 259, 260, 262, 265, 284, 293, 312, 314, 315, 316, 317, 318, 319, 321, 333, 338, 343, 346, 345, 392, 394, 400, 403, 410, 412 and 413 in a mature FIX polypeptide having a sequence set forth in SEQ ID NO:3, and the second amino acid replacement is at a position corresponding to a position selected from among 5, 53, 61, 64, 85, 155, 158, 159, 167, 239, 260, 284, 293, 312, 318, 333, 338, 346, 400, 403, 410, 412 and 413 in a mature FIX polypeptide having a sequence set forth in SEQ ID NO:3.

In some examples, the first or the second amino acid replacement is replacement with an amino acid residue selected from among alanine (Ala, A); arginine (Arg, R); asparagine (Asn, N); aspartic acid (Asp, D); cysteine (Cys, C); glutamic acid (Glu, E); glutamine (Gln, Q); glycine (Gly, G); histidine (His, H); isoleucine (Ile, I); leucine (Leu, L); lysine (Lys, K); methionine (Met, M); phenylalanine (Phe, F); proline (Pro, P); serine (Ser, S); threonine (Thr, T); tryptophan (Trp, W); tyrosine (Tyr, Y); and valine (Val, V), providing the replacing amino acid is not the same as the amino acid it replaces. In particular examples, the first amino acid replacement is replacement with an amino acid residue selected from among alanine; asparagine; aspartic acid, glutamic acid; glutamine; histidine; isoleucine; leucine; lysine; methionine; phenylalanine; serine; threonine; tyrosine and valine. For example, exemplary amino acid replacements include S53A, S61A, D64A, D64N, D85N, A103N, D104N, 105S, K106S, K106N, V108S, Y155F, Y155H, Y155Q, S158A, S158D, S158E, T159A, N167D, N167Q, T169A, T172A, T179A, V202M, V202Y, D203M, D203Y, A204M, A204Y, K228N, E239A, E239N, E239S, E239R, E239K, T241N, H243S, K247N, N249S, I251S, H257F, H257E, H257F, H257Y, H257S, Y259S, N260S, A262S, K265T, Y284N, K293E, K293A, R312Q, R312A, R312Y, R312L, F314N, H315S, K316S, K316N, K316A, K316E, K316S, K316M, G317N, R318A, R318E, R318Y, R318N, S319N, A320S, L321S, R333A, R333E, R333S, R338A, R338E, R338L, T343R, T343E, T343Q, F342I, Y345A, Y345T, N346D, N346Y, K392N, K394S, K400A, K400E, R403A, R403E, E410Q, E410N, E410D, E410S, E410A, T412A, T412V or K413N. Other exemplary amino acid replacements are conservative amino acid replacements.

In some instances, the second amino acid replacement is replacement with an amino acid residue selected from among alanine; arginine; asparagine; aspartic acid; glutamic acid; glutamine; histidine; leucine; lysine; phenylalanine; serine; threonine; tyrosine; or valine. For example, exemplary amino acid replacements include K5A, S53A, S61A, D64A, D64N, D85N, Y155F, Y155H, Y155Q, S158A, S158D, S158E, T159A, N167D, N167Q, E239A, E239N, E239S, E239R, E239K, N260S, Y284N, K293E, K293A, R312Q, R312A, R312Y, R312L, R318A, R318E, R318Y, R318N, R333A, R333E, R333S, R338A, R338E, R338L, N346D, N346Y, K400A, K400E, R403A, R403E, E410Q, E410N, E410D, E410S, E410A, T412A, T412V or K413N. Other exemplary amino acid replacements are conservative amino acid replacements.

In particular examples, the first amino acid replacement is at a position corresponding to a position selected from among 155, 247, 249, 318, 338, 403 and 410, such as, for example, Y155F, K247N, N249S, R318Y, R338E, R403E and E410N. In further examples, the second amino acid replacement is at a position corresponding to a position selected from among 155, 247, 249, 318, 338, 403 and 410, such as, for example, Y155F, K247N, N249S, R318Y, R338E, R403E and E410N.

Among the modified FIX polypeptides provided herein are those containing amino acid replacements selected from among amino acid replacements corresponding to K400E/ R403E, R318E/R403E, R318Y/E410N, K228N/R318Y, Y155F/K228N, Y155F/I251S, Y155F/N346D, Y155F/ N260S, R338E/T343R, E410N/T412A, E410N/T412V, R318Y/R338E, D85N/K228N, D85N/I251S, K400A/ R403A, R338A/R403A, R338E/R403E, K293A/R403A, K293E/R403E, R318A/R403A, R338E/E410N, K228N/ E410N, K228N/R338E, K228N/R338A and R403E/E410N.

In some examples, the modified FIX polypeptides contain one or more further amino acid replacements, such as one or more at a position selected from among 53, 61, 64, 85, 103, 104, 105, 106, 108, 155, 158, 159, 167, 169, 172, 179, 202, 203, 204, 205, 228, 239, 241, 243, 247, 249, 251, 257, 259, 260, 262, 265, 284, 293, 312, 314, 315, 316, 317, 318, 319, 321, 333, 338, 343, 346, 345, 392, 394, 400, 403, 410, 412 and 413 in a mature FIX polypeptide having a sequence set forth in SEQ ID NO:3. For example, the modified FIX polypeptides can contain a further amino acid replacement selected from among Y5A, S53A, S61A, D64A, D64N, D85N, A103N, D104N, N105S, K106S, K106N, V108S, Y155F, Y155H, Y155Q, S158A, S158D, S158E, T159A, N167D, N167Q, T169A, T172A, T179A, V202M, V202Y, D203M, D203Y, A204M, A204Y, K228N, E239A, E239N, E239S, E239R, E239K, T241N, H243S, K247N, N249S, I251S, H257F, H257E, H257F, H257Y, H257S, Y259S, N260S, A262S, K265T, Y284N, K293E, K293A, R312Q, R312A, R312Y, R312L, F314N, H315S, K316S, K316N, K316A, K316E, K316S, K316M, G317N, R318A, R318E, R318Y, R318N, S319N, A320S, L321S, R333A, R333E, R333S, R338A, R338E, R338L, T343R, T343E, T343Q, F342I, Y345A, Y345T, N346D, N346Y, K392N, K394S, K400A, K400E, R403A, R403E, E410Q, E410N, E410D, E410S, E410A, T412A, T412V and K413N, or a conservative amino acid replacement.

In some examples, the modified FIX polypeptides provided herein contain amino acid replacements selected from among amino acid replacements corresponding to R318Y/ R338E/R403E, D203N/F205T/R318Y, R318Y/R338E/ E410N, K228N/R318Y/E410N, R318Y/R403E/E410N, R318Y/R338E/R403E/E410N, D203N/F205T/R318Y/ E410N, A103N/N105S/R318Y/R338E/R403E/E410N, D104N/K106S/R318Y/R338E/R403E/E410N, K228N/ R318Y/R338E/R403E/E410N, I251S/R318Y/R338E/ R403E/E410N, D104N/K106S/I251S/R318Y/R338E/ R403E/E410N, D104N/K106S/R318Y/E410N/R338E, I251S/R318Y/E410N/R338E, D104N/K106S/I251S/ R318Y/E410N/R338E, A103N/N105S/Y155F, D104N/ K106S/Y155F, Y155F/K247N/N249S, A103N/N105S/ K247N/N249S/R318Y/R338E/R403E/E410N, D104N/ K106S/K247N/N249S/R318Y/R338E/R403E/E410N, K228N/K247N/N249S/R318Y/R338E/R403E/E410N, A103N/N105S/Y155F/R318Y/R338E/R403E/E410N, D104N/K106S/Y155F/R318Y/R338E/R403E/E410N, Y155F/K228N/R318Y/R338E/R403E/E410N, Y155F/ I251S/R318Y/R338E/R403E/E410N, Y155F/K247N/ N249S/R318Y/R338E/R403E/E410N, K247N/N249S/ R318Y/R338E/R403E/E410N, Y155F/R318Y/R338E/ R403E/E410N, K247N/N249S/R318Y/R338E/E240N, Y155F/R318Y/R338E/E410N, Y155F/K247N/N249S/

R318Y/R338E/E410N, D104N/K106S/Y155F/K228N/ K247N/N249S, D104N/K106S/Y155F/K247N/N249S, D104N/K106S/Y155F/K228N, Y155F/K228N/K247N/ N249S, R318Y/R338E/R403E/E410S, R318Y/R338E/ R403E/E410N/T412V, R318Y/R338E/R403E/E410N/ T412A, R318Y/R338E/R403E/T412A, R318Y/R338E/ E410S, R318Y/R338E/T412A, R318Y/R338E/E410N/ T412V, D85N/K228N/R318Y/R338E/R403E/E410N, N260S/R318Y/R338E/R403E/E410N, R318Y/R338E/ N346D/R403E/E410N, Y155F/R318Y/R338E/N346D/ R403E/E410N, Y155F/N260S/N346D, K247N/N249S/ N260S/R318Y/R338E/R403E/E410N, D104N/K106S/ N260S/R318Y/R338E/R403E/E410N, Y155F/N260S/ R318Y/R338E/R403E/E410N, R318Y/R338E/T343R/ R403E/E410N, D104N/K106S/Y155F/N260S, Y155F/ K247N/N249S/N260S, D104N/K106S/Y155F/K247N/ N249S/N260S, D104N/K106S/Y155F/K228N, D104N/ K106S/Y155F/K247N/N249S, D85N/D203N/F205T, D85N/D104N/K106S/I251S, K293A/R338A/R403A, K293E/R338E/R403E, R338E/R403E/E410N, D203N/ F205T/K228N, D203N/F205T/E410N, D203N/F205T/ R338E, D203N/F205T/R338A, D203N/F205T/R338E/ R403E, K228N/R338E/R403E, K247N/N249S/N260S, D104N/K106S/N260S, K228N/K247N/N249S/D104N/ K106S, A103N/N105S/K228N, D104N/K106S/K228N, A103N/N105S/I251S, D104N/K106S/I251S, A103N/ N105S/K247N/N249S, D104N/K106S/K247N/N249S, K228N/K247N/N249S, D104N/K106S/K228N/K247N/ N249S, K247N/N249S/N260S, D104N/K106S/N260S, Y259F/K265T/Y345T and D104N/K106S/K247N/N249S/ N260S.

Also provided herein are modified FIX polypeptides containing a modification in an unmodified FIX polypeptide, wherein the modification is selected from among modifications corresponding to amino acid replacements S61A, D64A, Y155F, N157D, S158A, S158D, S158E, N167D, N167Q, T169A, T172A, D203M, D203Y, A204M, A204Y, E239S, E239R, E239K, H257F, H257E, R312Y, R312L, K316M, R318E, R318Y, T343R, T343E, F342I, N346Y, K400E, E410D, E410S, E410A, T412A and T412V in a mature FIX polypeptide having a sequence set forth in SEQ ID NO:3. In some examples, the modified FIX polypeptide contains two or more of the amino acid replacements.

In particular instances, the modified FIX polypeptide contains the mutation Y155F. For example, provided are modified FIX polypeptides that contain Y155F and a modification at an amino acid position selected from among positions corresponding to 247, 249, 338, 403 and 410 of a mature FIX polypeptide having a sequence set forth in SEQ ID NO:3. In one example, the modified FIX contains Y155F/K247N/ N249S. In further instances, the modified FIX polypeptide contains the mutation R318Y. For example, provided are modified FIX polypeptides containing R318Y and a modification at an amino acid position selected from positions corresponding to 338, 403 and 410 of a mature FIX polypeptide having a sequence set forth in SEQ ID NO:3, such as, for example, R338E, R403E or E410N.

In some example, the modified FIX polypeptides contain one or more further modifications at an amino acid position selected from among positions corresponding to 5, 53, 61, 64, 85, 103, 104, 105, 106, 108, 148, 155, 157, 158, 159, 167, 169, 172, 179, 202, 202, 203, 204, 205, 228, 239, 241, 243, 247, 249, 251, 257, 259, 260, 262, 265, 284, 293, 312, 314, 315, 316, 317, 318, 319, 320, 321, 333, 338, 343, 345, 346, 392, 394, 400, 403, 410, 412 and 413 of a mature FIX polypeptide having a sequence set forth in SEQ ID NO:3. Exemplary modification(s) are selected from among modifications corresponding to amino acid replacements K5A, S53A, S61A, D64A, D64N, D85N, A103N, D104N, N105S, N105T, K106N, K106K, K106T, V108S, V108T, T148A, Y155F, Y155H, N157D, N157Q, S158A, S158D, S158E, T159A, N167D, N167Q, T169A, T172A, T179A, V202M, V202Y, D203M, D203Y, D203N, A204M, A204Y, F205S, F205T, K228N, E239N, T241N, E239S, E239A, E239R, E239K, H243S, H243T, K247N, N249S, N249T, I251S, I251T, H257F, H257Y, H257E, H257S, N260S, A262S, A262T, Y284N, K293E, K293A, R312Q, R312A, R312Y, R312L, F314N, H315S, K316S, K316T, K316M, G317N, R318E, R318Y, R318N, R318A, S319N, A320S, L321N, L321S, L321T, R333A, R333E, R338A, R338E, T343R, T343E, T343Q, F342I, Y345A, Y345T, N346D, N346T, K392N, K394E, K394T, K400A, K400E, R403A, R403E, E410Q, E410S, E410N, E410A, E410D, T412V, T412A and K413N.

Thus, provided herein are modified FIX polypeptides containing modifications selected from among modifications corresponding to amino acid replacements K400E/R403E, R318E/R403E, R318Y/E410N, R318Y/R338E/R403E, D203N/F205T/R318Y, K228N/R318Y, R318Y/R338E/ E410N, K228N/R318Y/E410N, R318Y/R403E/E410N, R318Y/R338E/R403E/E410N, D203N/F205T/R318Y/ E410N, A103N/N105S/R318Y/R338E/R403E/E410N, D104N/K106S/R318Y/R338E/R403E/E410N, K228N/ R318Y/R338E/R403E/E410N, I251S/R318Y/R338E/ R403E/E410N, D104N/K106S/I251S/R318Y/R338E/ R403E/E410N, D104N/K106S/R318Y/E410N/R338E, I251S/R318Y/E410N/R338E, D104N/K106S/I251S/ R318Y/E410N/R338E, A103N/N105S/Y155F, D104N/ K106S/Y155F, Y155F/K228N, Y155F/I251S, Y155F/ K247N/N249S, A103N/N105S/K247N/N249S/R318Y/ R338E/R403E/E410N, D104N/K106S/K247N/N249S/ R318Y/R338E/R403E/E410N, K228N/K247N/N249S/ R318Y/R338E/R403E/E410N, A103N/N105S/Y155F/ R318Y/R338E/R403E/E410N, D104N/K106S/Y155F/ R318Y/R338E/R403E/E410N, Y155F/K228N/R318Y/ R338E/R403E/E410N, Y155F/I251S/R318Y/R338E/ R403E/E410N, Y155F/K247N/N249S/R318Y/R338E/ R403E/E410N, K247N/N249S/R318Y/R338E/R403E/ E410N, Y155F/R318Y/R338E/R403E/E410N, K247N/ N249S/R318Y/R338E/E240N, Y155F/R318Y/R338E/ E410N, Y155F/K247N/N249S/R318Y/R338E/E410N, D104N/K106S/Y155F/K228N/K247N/N249S, D104N/ K106S/Y155F/K247N/N249S, D104N/K106S/Y155F/ K228N, Y155F/K228N/K247N/N249S, R318Y/R338E/ R403E/E410S, R318Y/R338E/R403E/E410N/T412V, R318Y/R338E/R403E/E410N/T412A, R318Y/R338E/ R403E/T412A, R318Y/R338E/E410S, R318Y/R338E/ T412A, R318Y/R338E/E410N/T412V, D85N/K228N/ R318Y/R338E/R403E/E410N, N260S/R318Y/R338E/ R403E/E410N, R318Y/R338E/N346D/R403E/E410N, Y155F/N346D, Y155F/R318Y/R338E/N346D/R403E/ E410N, Y155F/N260S, Y155F/N260S/N346D, K247N/ N249S/N260S/R318Y/R338E/R403E/E410N, D104N/ K106S/N260S/R318Y/R338E/R403E/E410N, Y155F/ N260S/R318Y/R338E/R403E/E410N, R318Y/R338E/ T343R/R403E/E410N, D104N/K106S/Y155F/N260S, Y155F/K247N/N249S/N260S, R338E/T343R and D104N/ K106S/Y155F/K247N/N249S/N260S, D104N/K106S/ Y155F/K228N, D104N/K106S/Y155F/K247N/N249S, T343R/Y345T, E410N/T412A, R410N/T412V and R318Y/ R338E. In particular examples, the modified FIX polypeptides contain modifications corresponding to amino acid replacements R318Y/R338E/R403E/E410N or Y155F/ K247N/N249S/R318Y/R338E/R403E/E410N.

In some instances, the unmodified FIX polypeptide contains a sequence of amino acids set forth in any of SEQ ID NOS: 2, 3, 20 or 325, or is a species variant thereof, or a variant having at least 60% sequence identity with the FIX of any of SEQ ID NOS: 2, 3, 20 or 325, or is an active fragment of a FIX polypeptide that comprises a sequence of amino acids set forth in any SEQ ID NOS: 2, 3, 20 or 325. For example, the species variant can have sequence of amino acids set forth in any of SEQ ID NOS: 4-18. In other examples, the variant having at least 60% sequence identity with the FIX of any of SEQ ID NOS: 2, 3, 20 or 325, has a sequence of amino acids set forth in any of SEQ ID NOS: 75-272. In further examples, the modified FIX polypeptide is an active fragment of an unmodified FIX polypeptide; and the modified FIX polypeptide contains the modification(s).

Any of the modified FIX polypeptides provided herein of can contain one or more modifications that introduces and/or eliminates one or more glycosylation sites compared to the unmodified FIX polypeptide. In some examples, the glycosylation sites are selected from among, N-, O- and S-glycosylation sites. In one example, one or more N-glycosylation sites are introduced compared to the unmodified FIX polypeptide. In some examples, the N-glycosylation site is introduced at an amino acid positions corresponding to positions selected from among Y1, S3, G4, K5, L6, E7, F9, V10, Q11, G12, L14, E15, R16, M19, E20, K22, S24, F25, E26, E27, A28, R29, E30, V31, F32, E33, T35, E36, R37, T39, E40, F41, W42, K43, Q44, Y45, V46, D47, G48, D49, Q50, E52, S53, N54, L57, N58, G59, S61, K63, D65, I66, N67, S68, Y69, E70, W72, P74, F77, G79, K80, N81, E83, L84, D85, V86, T87, N89, I90, K91, N92, R94, K100, N101, S102, A103, D104, N105, K106, V108, S110, E113, G114, R116, E119, N120, Q121, K122, K123, E125, P126, V128, P129, F130, R134, V135, S136, S138, Q139, T140, S141, K142, A146, E147, A148, V149, F150, P151, D152, V153, D154, Y155, V156, S158, T159, E160, A161, E162, T163, I164, L165, D166, I168, T169, Q170, S171, T172, Q173, S174, F175, N176, D177, F178, T179, R180, G183, E185, D186, K188, P189, K201, V202, D203, E213, E224, T225, G226, K228, E239, E240, T241, H243, K247, N249, I251, R252, I253, P255, H257, N258, N260, A261, A262, I263, N264, K265, A266, D276, E277, P278, V280, N282, S283, Y284, D292, K293, E294, N297, I298, K301, F302, G303, S304, Y306, R312, F314, H315, K316, G317, R318, S319, L321, V322, Y325, R327, P329, L330, D332, R333, A334, T335, L337, R338, K341, F342, T343, Y345, N346, H354, E355, G357, R358, Q362, E372, E374, G375, E388, M391, K392, G393, K394, R403, N406, K409, E410, K411, and K413 of the mature FIX polypeptide set forth in SEQ ID NO:3.

Exemplary modifications that introduce a glycosylation include those selected from among modification corresponding to amino acid replacements Y1N, Y1N+S3T, S3N+K5S/T, G4T, G4N+L6S/T, K5N+E7T, L6N+E8T, E7N+F9T, F9N+Q11S/T, V10N+G12S/T, Q11N+N13T, G12N+L14S/T, L14N+R16T, E15T, E15N+E17T; R16N+C18S/T, M19N+E21T; E20N+K22T, K22N, S24N+E26T; F25N+E27T; E26N+A28T; E27N+R29T; A28N+E30T; R29N+V31S/T, E30N+F32T; V31N+E33T; F32N+N34T, E33N, T35N+R37S/T, E36T; E36N; R37N, T39N+F41S/T, E40N+W42T, F41N+K43S/T, W42N+Q44S/T, K43N+Y45T; Q44N+V46S/T, Y45N+D47T, V46N+G48S/T, D47N+D49S/T, G48N+Q50S/T, D49N+C51S/T, Q50N+E52S/T, E52N+N54T, S53N+P55S/T, C56S/T, L57N+G59S/T, G59N+S61T; G60S/T, S61N+K63S/T, K63N+D65S/T, D65N+N67S/T, I66N+S68S/T, Y69S/T, Y69N+C71S/T, S68N+E70S/T, E70N+W72S/T, W72N+P74S/T, P74N+G76S/T, F75N, G76N+E78T, E78N+K80T, F77T, F77N+G79S/T, G79N+N81S/T, K80N+C82S/T, E83S/T, E83N+D85S/T, L84N+V86S/T, D85N, V86A, V86N+C88S/T, T87N+N89S/T, I90N+N92S/T, K91S/T, I90N+N92S/T, K91N+G93S/T, R94S/T, R94N+E96S/T, K100N, A103S/T, S102N+D104S/T, A103N+N105S/T, D104N+K106S/T, V107S/T, K106N+V108S/T, V108N+V110S/T, S111N, E113N+Y115S/T, G114N+R116S/T, R116N+A118S/T, E119N+Q121S/T, K122S/T, Q121N+S123S/T, K122N+C124S/T S123N+E125S/T, E125N+A125S/T, P126N+V128S/T, A127N+P129T, V128N+F130S/T, P129N+P131S/T, F130N+C132S/T, R134N, V135N+V137S/T, S136N, S138N, V137N+Q139T; Q139N, T140N+L142S/T, S141N+L143S/T, K142N, A146N+A148S/T, E147N+V149S/T, T148N+F150S/T, V149N+P151S/T, F150N+D152S/T, P151N+V153S/T, D152N+D154S/T, V153N+Y155S/T, D154N+V156S/T, Y155N+N157S/T, V156N, S158N+E160S/T, T159N+A161S/T, E160N+E162S/T, A161N, E162N+I164S/T, T163N+L165S/T, I164N+D166S/T, L165N+N167S/T, D166N+I168S/T, I168N+Q170S/T, T169N, Q170N, S171N+Q173S/T, T172N, Q173N+F175S/T, S174N+N176S/T, F175N+D177S/T, F178S/T, D177N, D177E, F178N+R180S/T, T179N+V181S/T, R180N+V182S/T, G183+E185S/T, G184N+D186T, E185N+A187S/T, D186N+K188S/T, A187N+P189T, K188N+G190S/T, P189N+Q181S/T, G200N+V202T, K201N+D203S/T, K201T, V202N+A204S/T, D203N+F205S/T, E213N+W215S/T, K214T, V223T, E224N+G226S/T, T225N+V227S/T, G226N+K228S/T, V227N+I229T, K228N, H236N+I238T; I238N+E240T; E239N, E240N+E242S/T, E242N, T241N+H243S/T, H243N+E245S/T, K247N+N249S/T, V250N+R252T, I251S/T, I251N+I253S/T, R252N+I254S/T, I253N+P255S/T, P255N+H257S/T, H257N+Y259S/T, N260S/T, A262S/T, A261N+I263S/T, A262N+N264S/T, I263N+K265S/T, K265N+N267S/T, A266N+H268S/T, D276N+P278S/T, P278N+V280S/T, E277N+L279S/T, V280N+N282S/T, Y284S/T, S283N+V285S/T, Y284N, D292N+K294S/T, K293N+Y295S/T, E294N, F299S/T, I298N+L300S/T, K301N+G303S/T, F302N, G303N+G305S/T, S304N+Y306S/T, Y306N+S308S/T, R312N+F314S/T, V313N+H315T, F314N+K316S/T, H315N+G317S/T, K316N+R138S/T, G317N, R318N+A320S/T, S319N+L321S/T, A320N+V322T, L321N+L323S/T, V322N+Q324S/T, Y325N+R327S/T, R327N+P329S/T, P329N+V331S/T, L330N+D332S/T, D332N+A334S/T, R333N, A334N+C336S/T, T335N+L337S/T, L337N, R338N, S339N+K341T, T340N+F342T; K341N, F342N+I344S/T, T343N+Y345S/T, Y345N+N347S/T, M348S/T, G352N+H354T, F353N, F353N+E355T, H354N+G356S/T, H354V, H354I, E355T, E355N+G357S/T, G356N+R358T, G357N+D359S/T, R358N, Q362N+D364S/T, V370N; T371V; T371I; E372T, E372N+E374S/T, E374N, G375N, W385N+E387T; G386N+E388T, E388N+A390S/T, A390N+K392T, M391N+G393S/T, K392N+K394S/T, K392V, G393T, G393N+Y395S/T, K394N+G396S/T, R403N+V405S/T, I408S/T, K409N+K411S/T, E410N, K411N+K413S/T, and K413N. In some examples, 1, 2, 3, 4, 5, 6, 7, 8 or more glycosylation sites are introduced.

Also provided herein are modified FIX polypeptides containing one or more modifications that eliminates one or more N-glycosylation sites compared to the unmodified FIX polypeptide. For example, N-glycosylation sites at an amino acid positions corresponding to N157 or N167 of the mature FIX polypeptide set forth in SEQ ID NO:3 can be eliminated. Exemplary modifications that eliminate an N-glycosylation site include those selected from among modifications corresponding to amino acid replacements N157D, N157Q, N167D and N167Q. In further examples, the FIX polypeptide contain one or more modifications that eliminates one or more O-glycosylation sites compared to the unmodified FIX polypeptide. For example, O-glycosylation sites that can be eliminated include those an amino acid positions corresponding to positions selected from among S53, S61, T159 and T169 of the mature FIX polypeptide set forth in SEQ ID NO:3. Exemplary modifications that eliminate an N-glycosylation site include those selected from among modifications corresponding to amino acid replacements S53A, S61A, T159A and T169A.

Also provided are modified FIX polypeptides containing one or more modifications that introduces and/or eliminates one or more sulfation sites compared to the unmodified FIX polypeptide. In one example, the modified FIX polypeptides contain a modification that eliminates a sulfation site at an amino acid position corresponding to position Y155 of the mature FIX polypeptide set forth in SEQ ID NO:3. Exemplary of such modifications are those that correspond to amino acid replacements Y155H, Y155F and Y155Q.

Provided are modified FIX polypeptides containing one or more modifications that introduces and/or eliminates one or more phosphorylation sites compared to the unmodified FIX polypeptide. In one example, the modified FIX polypeptides contains a modification that eliminates a phosphorylation site at an amino acid position corresponding to position S158 of the mature FIX polypeptide set forth in SEQ ID NO:3. Exemplary of such modifications are those that correspond to amino acid replacements S158A, S158D and S158E. Also provided are FIX polypeptides containing one or more modifications that introduces and/or eliminates one or more β-hydroxylation sites compared to the unmodified FIX polypeptide. In one instance, the modified FIX polypeptides contain a modification that eliminates a β-hydroxylation site at an amino acid position corresponding to position D64 of the mature FIX polypeptide set forth in SEQ ID NO:3. Exemplary of such modifications are those that correspond to amino acid replacements D64N and D64A.

Any of the modified FIX polypeptides provided herein can contain any other mutations known in the art, such as, for example, one or more modifications selected from among amino acid replacements Y1A, Y1C, Y1D, Y1E, Y1G, Y1H, Y1K, Y1N, Y1P, Y1Q, Y1R, Y1S, Y1T, S3T, K5A, K5I, K5L, K5F, K5E, L6A, L6C, L6D, L6E, L6G, L6H, L6K, L6N, L6P, L6Q, L6R, L6S, L6T, L6M, F9A, F9C, F9D, F9E, F9G, F9H, F9K, F9N, F9P, F9Q, F9R, F9S, F9T, F9I, F9M, F9W, V10A, V10C, V10D, V10E, V10G, V10H, V10K, V10N, V10P, V10Q, V10R, V10S, V10T, V10F, V10I, V10K, V10M, V10W, V10Y, Q11E, Q11D, Q11A, Q11C, Q11G, Q11P, G12D, G12E, G12G, G12H, G12K, G12N, G12P, G12Q, G12R, G12S, G12T, N13A, N13C, N13G, N13H, N13P, N13T, L14A, L14C, L14D, L14E, L14G, L14H, L14K, L14N, L14P, L14Q, L14R, L14S, L14T, L14F, L14I, L14M, L14V, L14W, L14Y, E15D, E15H, E15P, R16E, R16A, R16C, R16G, R16P, R16T, E17A, E17C, E17G, E17P, E17T, C18D, C18E, C18G, C18H, C18K, C18N, C18P, C18Q, C18R, C18S, C18T, M19A, M19C, M19D, M19E, M19G, M19H, M19K, M19N, M19P, M19Q, M19R, M19S, M19T, M19F, M19I, M19M, M19V, M19W, M19Y, E20A, E20C, E20G, E20P, E20T, E21A, E21C, E21G, E21P, K22H, K22P, K22T, S24H, S24P, F25A, F25C, F25D, F25E, F25G, F25H, F25K, F25N, F25P, F25Q, F25R, F25S, F25T, F25I, F25M, F25W, F25Y, E26A, E26C, E26G, E26P, E27A, E27C, E27G, E27H, E27P, E27S, E27T, A28C, A28D, A28E, A28G, A28H, A28K, A28N, A28P, A28Q, A28R, A28S, A28T, R29A, R29C, R29G, R29P, R29F, E30D, E30H, E30P, V31A, V31C, V31D, V31E, V31G, V31H, V31K, V31N, V31P, V31Q, V31R, V31S, V31T, V31F, V31I, V31W, V31Y, F32A, F32C, F32D, F32E, F32G, F32H, F32K, F32N, F32P, F32Q, F32R, F32S, F32T, E33H, E33N, E33P, E33Q, E33S, E33T, N34E, N34D, N34F, N34I, N34L, T35D, T35E, T35A, T35C, T35G, T35P, F41A, F41C, F41D, F41E, F41G, F41H, F41K, F41N, F41P, F41Q, F41R, F41S, F41T, F41M, F41W, F41Y, W42A, W42C, W42D, W42E, W42G, W42H, W42K, W42N, W42P, W42Q, W42R, W42S, W42T, K43A, K43C, K43G, K43P, Q44P, Q44T, Q44, Y45A, Y45C, Y45D, Y45E, Y45G, Y45H, Y45K, Y45N, Y45P, Y45Q, Y45R, Y45S, Y45T, V46A, V46C, V46D, V46E, V46G, V46H, V46K, V46N, V46P, V46Q, V46R, V46S, V46T, V46F, V46I, V46M, V46W, V46Y, D47A, D47C, D47G, D47H, D47P, D47T, G48D, G48E, G48P, G48T, D49H, D49P, D49Q, D49T, Q50A, Q50C, Q50D, Q50G, Q50H, Q50P, Q50T, C51D, C51E, C51G, C51H, C51K, C51N, C51P, C51Q, C51R, C51S, C51T, E52P, E52T, S53A, S53C, S53G, S53H, S53P, S53T, N54H, N54P, N54T, L57A, L57C, L57D, L57E, L57G, L57H, L57K, L57N, L57P, L57Q, L57R, L57S, L57T, L57F, L57I, L57M, L57W, L57Y, G60C, G60D, G60H, G60P, G60T, C62D, C62H, C62P, K63T, D65H, D65T, I66A, I66C, I66D, I66E, I66G, I66H, I66K, I66N, I66P, I66Q, I66R, I66S, I66T, I66M, I66W, I66Y, Y69A, Y69C, Y69D, Y69E, Y69G, Y69H, Y69K, Y69N, Y69P, Y69Q, Y69R, Y69S, Y69T, C71H, C71P, W72A, W72C, W72D, W72E, W72G, W72H, W72K, W72N, W72P, W72Q, W72R, W72S, W72T, W72I, W72Y, F75A, F75C, F75D, F75E, F75G, F75H, F75K, F75N, F75P, F75Q, F75R, F75S, F75T, F77A, F77C, F77D, F77E, F77G, F77H, F77K, F77N, F77P, F77Q, F77R, F77S, F77T, L84A, L84C, L84D, L84E, L84G, L84H, L84K, L84N, L84P, L84Q, L84R, L84S, L84T, L84M, L84W, L84Y, V86I, V86L, V86M, V86F, V86W, V86Y, V86A, V86C, V86D, V86E, V86G, V86H, V86K, V86N, V86P, V86Q, V86R, V86S, V86T, I90A, I90C, I90D, I90E, I90G, I90H, I90K, I90N, I90P, I90Q, I90R, I90S, I90T, I90M, I90W, K91A, K91C, K91G, K91P, N92A, N92C, N92G, N92P, N92T, G93D, G93E, G93H, G93K, G93N, G93P, G93Q, G93R, G93S, G93T, R94A, R94C, R94G, R94P, C95D, C95E, C95G, C95H, C95K, C95N, C95P, C95Q, C95R, C95S, C95T, E96P, E96T, Q97A, Q97C, Q97G, Q97P, F98A, F98C, F98D, F98E, F98G, F98H, F98K, F98N, F98P, F98Q, F98R, F98S, F98T, F98M, F98W, F98Y, K100A, K100C, K100G, K100P, N101H, N101T, A103D, A103E, A103H, A103K, A103N, A103P, A103Q, A103R, A103S, A103T, D104T, K106H, K106P, K106T, V107A, V107C, V107D, V107E, V107G, V107H, V107K, V107N, V107P, V107Q, V107R, V107S, V107T, V108A, V108C, V108D, V108E, V108G, V108H, V108K, V108N, V108P, V108Q, V108R, V108S, V108T, V108F, V108M, V108W, V108Y, S110A, S110C, S110G, S110P, C111D, C111E, C111H, C111K, C111N, C111P, C111Q, C111R, C111S, C111T, T112A, T112C, T112G, T112P, E113D, E113H, E113P, G114D, G114E, G114H, G114K, G114N, G114P, G114Q, G114R, G114S, G114T, Y115A, Y115C, Y115D, Y115E, Y115G, Y115H, Y115K, Y115N, Y115P, Y115Q, Y115R, Y115S, Y115T, Y115M, Y115W, R116P, R116T, L117A, L117C, L117D, L117E, L117G, L117H, L117K, L117N, L117P, L117Q, L117R, L117S, L117T, A118D, A118E, A118H, A118K, A118N, A118P, A118Q, A118R, A118S, A118T, N120D, N120H, N120P, Q121P, S123H, S123T, V128A, V128C, V128D, V128E, V128G, V128H, V128K, V128N, V128P, V128Q, V128R, V128S, V128T, F130A, F130C, F130D, F130E, F130G, F130H, F130K, F130N, F130P, F130Q, F130R, F130S, F130T, V135A, V135C, V135D, V135E, V135G, V135H, V135K, V135N, V135P, V135Q, V135R, V135S, V135T, V135W, V135Y, V137A, V137C, V137D, V137E, V137G, V137H, V137K, V137N, V137P, V137Q, V137R, V137S, V137T, V137M, V137W, V137Y, S138H, S138T, T140D, T140H, S141T, K142H, K142P, L143A, L143C, L143D, L143E, L143G, L143H, L143K, L143N, L143P, L143Q, L143R, L143S, L143T, L143F, L143I, L143M, L143V, L143W, L143Y, R145H, R145P, R145T, A146P, A146T, T148H, T148P, V149A, V149C, V149D, V149E, V149G, V149H, V149K, V149N, V149P, V149Q, V149R, V149S, V149T, V149F, V149I, V149M, V149W, V149Y, F150A, F150C, F150D, F150E, F150G, F150H, F150K, F150N, F150P, F150Q, F150R, F150S, F150T, F150M, F150W, F150Y, D152A, D152C, D152G, D152P, D152S, D152T, V153A, V153C, V153D, V153E, V153G, V153H, V153K, V153N, V153P, V153Q, V153R, V153S, V153T, V153F, V153I, V153M, V153W, V153Y, D154A, D154C, D154G, D154P, D154Q, D154S, Y155A, Y155C, Y155D, Y155E, Y155G, Y155H, Y155K, Y155N, Y155P, Y155Q, Y155R, Y155S, Y155T, Y155M, Y155V, Y155W, V156A, V156C, V156D, V156E, V156G, V156H, V156K, V156N, V156P, V156Q, V156R, V156S, V156T, V156I, V156M, V156W, V156Y, N157A, N157C, N157G, N157H, N157P, N157Q, N157T, S158H, S158P, S158T, T159A, T159C, T159G, T159P, E160A, E160C, E160G, E160P, A161C, A161D, A161E, A161H, A161K, A161N, A161P, A161Q, A161R, A161S, A161T, E162P, E162T, T163A, T163C, T163G, T163P, I164A, I164C, I164D, I164E, I164G, I164H, I164K, I164N, I164P, I164Q, I164R, I164S, I164T, L165A, L165C, L165D, L165E, L165G, L165H, L165K, L165N, L165P, L165Q, L165R, L165S, L165T, L165M, L165W, L165Y, I168A, I168C, I168D, I168E, I168G, I168H, I168K, I168N, I168P, I168Q, I168R, I168S, I168T, F175A, F175C, F175D, F175E, F175G, F175H, F175K, F175N, F175P, F175Q, F175R, F175S, F175T, F178A, F178C, F178D, F178E, F178G, F178H, F178K, F178N, F178P, F178Q, F178R, F178S, F178T, F178M, F178W, F178Y, T179A, T179C, T179G, T179P, R180A, R180C, R180D, R180G, R180H, R180P, V181A, V181C, V181D, V181E, V181G, V181H, V181K, V181N, V181P, V181Q, V181R, V181S, V181T, V181F, V181I, V181M, V181W, V181Y, V182A, V182C, V182D, V182E, V182G, V182H, V182K, V182N, V182P, V182Q, V182R, V182S, V182T, V182F, V182I, V182M, V182W, V182Y, G183D, G183E, G183H, G183K, G183N, G183P, G183Q, G183S, G183T, G184D, G184E, G184H, G184K, G184N, G184P, G184Q, G184R, G184S, G184T, E185A, E185C, E185G, E185H, E185P, E185T, D186A, D186C, D186G, D186H, D186P, D186T, A187C, A187D, A187E, A187G, A187H, A187K, A187N, A187P, A187Q, A187R, A187S, A187T, K188A, K188C, K188G, K188H, K188P, K188T, G190D, G190E, G190H, G190K, G190N, G190P, G190Q, G190R, G190S, G190T, F192A, F192C, F192D, F192E, F192G, F192H, F192K, F192N, F192P, F192Q, F192R, F192S, F192T, F192W, F192Y, W194A, W194C, W194D, W194E, W194G, W194H, W194K, W194N, W194P, W194Q, W194R, W194S, W194T, Q195H, Q195P, Q195T, V196A, V196C, V196D, V196E, V196G, V196H, V196K, V196N, V196P, V196Q, V196R, V196S, V196T, V196F, V196I, V196M, V196W, V196Y, V197A, V197C, V197D, V197E, V197G, V197H, V197K, V197N, V197P, V197Q, V197R, V197S, V197T, V197F, V197I, V197M, V197W, V197Y, L198A, L198C, L198D, L198E, L198G, L198H, L198K, L198N, L198P, L198Q, L198R, L198S, L198T, L198I, L198Y, N199A, N199C, N199G, N199H, N199P, N199S, N199T, G200P, G200T, K201A, K201C, K201D, K201E, K201G, K201H, K201N, K201P, K201Q, K201S, K201T, V202A, V202C, V202D, V202E, V202G, V202H, V202K, V202N, V202P, V202Q, V202R, V202S, V202T, V202F, V202I, V202M, V202W, V202Y, D203A, D203C, D203G, D203P, D203T, A204C, A204D, A204E, A204G, A204H, A204K, A204N, A204P, A204Q, A204R, A204S, A204T, F205A, F205C, F205D, F205E, F205G, F205H, F205K, F205N, F205P, F205Q, F205R, F205S, F205T, F205M, F205V, F205W, F205Y, G207H, G207P, G208C, G208D, G208E, G208H, G208K, G208N, G208P, G208Q, G208R, G208S, G208T, S209A, S209C, S209G, S209P, I210A, I210C, I210D, I210E, I210G, I210H, I210K, I210N, I210P, I210Q, I210R, I210S, I210T, I210F, I210W, I210Y, V211A, V211C, V211D, V211E, V211G, V211H, V211K, V211N, V211P, V211Q, V211R, V211S, V211T, V211F, V211I, V211M, V211W, N212A, N212C, N212G, N212P, E213H, E213P, E213S, E213T, K214T, W215A, W215C, W215D, W215E, W215G, W215H, W215K, W215N, W215P, W215Q, W215R, W215S, W215T, I216A, I216C, I216D, I216E, I216G, I216H, I216K, I216N, I216P, I216Q, I216R, I216S, I216T, V217A, V217C, V217D, V217E, V217G, V217H, V217K, V217N, V217P, V217Q, V217R, V217S, V217T, V217I, V217Y, A219H, A219P, A219T, V223A, V223C, V223D, V223E, V223G, V223H, V223K, V223N, V223P, V223Q, V223R, V223S, V223T, V223M, V223W, V223Y, G226P, V227A, V227C, V227D, V227E, V227G, V227H, V227K, V227N, V227P, V227Q, V227R, V227S, V227T, V227F, V227I, V227M, V227W, V227Y, K228A, K228C, K228G, K228H, K228P, I229A, I229C, I229D, I229E, I229G, I229H, I229K, I229N, I229P, I229Q, I229R, I229S, I229T, I229M, I229W, I229Y, T230A, T230C, T230G, T230P, V231A, V231C, V231D, V231E, V231G, V231H, V231K, V231N, V231P, V231Q, V231R, V231S, V231T, V232A, V232C, V232D, V232E, V232G, V232H, V232K, V232N, V232P, V232Q, V232R, V232S, V232T, V232F, V232I, V232M, V232W, V232Y, A233C, A233D, A233E, A233G, A233H, A233K, A233N, A233P, A233Q, A233R, A233S, A233T, A233V, G234D, G234E, G234H, G234K, G234N, G234P, G234Q, G234R, G234S, G234T, E235H, E235N, E235P, E235Q, E235S, E235T, H236A, H236C, H236G, H236P, N237A, N237C, N237G, N237P, N237T, I238A, I238C, I238D, I238E, I238G, I238H, I238K, I238N, I238P, I238Q, I238R, I238S, I238T, E239A, E239C, E239G, E239P, E240H, E240T, V250A, V250C, V250D, V250E, V250G, V250H, V250K, V250N, V250P, V250Q, V250R, V250S, V250T, V250M, V250W, V250Y, I251A, I251C, I251D, I251E, I251G, I251H, I251K, I251N, I251P, I251Q, I251R, I251S, I251T, I253A, I253C, I253D, I253E, I253G, I253H, I253K, I253N, I253P, I253Q, I253R, I253S, I253T, I253M, I253W, I253Y, I254A, I254C, I254D, I254E, I254G, I254H, I254K, I254N, I254P, I254Q, I254R, I254S, I254T, P255H, H256P, H256T, H257A, H257C, H257G, H257P, N258P, N258T, Y259A, Y259C, Y259D, Y259E, Y259G, Y259H, Y259K, Y259N, Y259P, Y259Q, Y259R, Y259S, Y259T, Y259M, Y259W, Y259F, N260A, N260C, N260G, N260P, A261D, A261E, A261H, A261K, A261N, A261P, A261Q, A261R, A261S, A261T, A262C, A262D, A262E, A262G, A262H, A262K, A262N, A262P, A262Q, A262R, A262S, A262T, I263A, I263C, I263D, I263E, I263G, I263H, I263K, I263N, I263P, I263Q, I263R, I263S, I263T, I263M, I263V, I263W, I263Y, N264A, N264C, N264D, N264G, N264H, N264P, K265A, K265C, K265G, K265H, K265P, K265T, Y266A, Y266C, Y266D, Y266E, Y266G, Y266H, Y266K, Y266N, Y266P, Y266Q, Y266R, Y266S, Y266T, Y266M, Y266W, N267A, N267C, N267G, N267H, N267P, N267T, H268P, D269A, D269C, D269E, D269G, D269H, D269N, D269P, D269Q, D269S, D269T, I270A, I270C, I270D, I270E, I270G, I270H, I270K, I270N, I270P, I270Q, I270R, I270S, I270T, I270M, I270W, A271C, A271D, A271E, A271G, A271H, A271K, A271N, A271P, A271Q, A271R, A271S, A271T, L272A, L272C, L272D, L272E, L272G, L272H, L272K, L272N, L272P, L272Q, L272R, L272S, L272T, L272F, L273A, L273C, L273D, L273E, L273G, L273H, L273K, L273N, L273P, L273Q, L273R, L273S, L273T, L273F, L273I, L273M, L273V, L273W, L273Y, E274A, E274C, E274G, E274P, E274T, L275A, L275C, L275D, L275E, L275G, L275H, L275K, L275N, L275P, L275Q, L275R, L275S, L275T, L275W, L275Y, D276P, D276S, D276T, E277A, E277C, E277G, E277P, E277V, E277N, E277D, E277E, E277Q, E277H, E277I, E277L, E277M, E277F, E277S, E277T, E277W, E277Y, P278T, L279A, L279C, L279D, L279E, L279G, L279H, L279K, L279N, L279P, L279Q, L279R, L279S, L279T, L279I, L279Y, V280A, V280C, V280D, V280E, V280G, V280H, V280K, V280N, V280P, V280Q, V280R, V280S, V280T, V280F, V280I, V280W, V280Y, L281A, L281C, L281D, L281E, L281G, L281H, L281K, L281N, L281P, L281Q, L281R, L281S, L281T, L281F, L281I, L281V, L281W, L281Y, S283A, S283C, S283G, S283P, Y284A, Y284C, Y284D, Y284E, Y284G, Y284H, Y284K, Y284N, Y284P, Y284Q, Y284R, Y284S, Y284T, Y284M, V285A, V285C, V285D, V285E, V285G, V285H, V285K, V285N, V285P, V285Q, V285R, V285S, V285T, V285M, V285W, V285Y, T286A, T286C, T286G, T286P, I288A, I288C, I288D, I288E, I288G, I288H, I288K, I288N, I288P, I288Q, I288R, I288S, I288T, C289D, C289H, C289P, I290A, I290C, I290D, I290E, I290G, I290H, I290K, I290N, I290P, I290Q, I290R, I290S, I290T, I290Y, A291D, A291E, A291H, A291K, A291N, A291P, A291Q, A291R, A291S, A291T, D292A, D292C, D292G, D292P, D292T, K293H, K293P, K293T, Y295A, Y295C, Y295D, Y295E, Y295G, Y295H, Y295K, Y295N, Y295P, Y295Q, Y295R, Y295S, Y295T, Y295W, T296A, T296C, T296G, T296P, N297A, N297C, N297G, N297P, I298A, I298C, I298D, I298E, I298G, I298H, I298K, I298N, I298P, I298Q, I298R, I298S, I298T, F299A, F299C, F299D, F299E, F299G, F299H, F299K, F299N, F299P, F299Q, F299R, F299S, F299T, L300A, L300C, L300D, L300E, L300G, L300H, L300K, L300N, L300P, L300Q, L300R, L300S, L300T, L300F, L300I, L300M, L300V, L300W, L300Y, K301A, K301C, K301G, K301P, K301T, F302A, F302C, F302D, F302E, F302G, F302H, F302K, F302N, F302P, F302Q, F302R, F302S, F302T, G303H, G303P, G303T, S304A, S304C, S304G, S304P, S304T, G305D, G305E, G305H, G305N, G305P, G305Q, G305S, G305T, Y306A, Y306C, Y306D, Y306E, Y306G, Y306H, Y306K, Y306N, Y306P, Y306Q, Y306R, Y306S, Y306T, V307A, V307C, V307D, V307E, V307G, V307H, V307K, V307N, V307P, V307Q, V307R, V307S, V307T, S308P, S308T, W310A, W310C, W310D, W310E, W310G, W310H, W310K, W310N, W310P, W310Q, W310R, W310S, W310T, G311T, V313A, V313C, V313D, V313E, V313G, V313H, V313K, V313N, V313P, V313Q, V313R, V313S, V313T, F314A, F314C, F314D, F314E, F314G, F314H, F314K, F314N, F314P, F314Q, F314R, F314S, F314T, F314M, F314W, F314Y, H315A, H315C, H315G, H315P, K316A, K316C, K316G, K316P, G317C, G317D, G317E, G317H, G317K, G317N, G317P, G317Q, G317R, G317S, G317T, R318A, R318C, R318G, R318P, S319D, S319H, S319N, S319P, S319Q, A320C, A320D, A320E, A320G, A320H, A320K, A320N, A320P, A320Q, A320R, A320S, A320T, L321A, L321C, L321D, L321E, L321G, L321H, L321K, L321N, L321P, L321Q, L321R, L321S, L321T, V322A, V322C, V322D, V322E, V322G, V322H, V322K, V322N, V322P, V322Q, V322R, V322S, V322T, V322Y, L323A, L323C, L323D, L323E, L323G, L323H, L323K, L323N, L323P, L323Q, L323R, L323S, L323T, L323F, L323I, L323M, L323V, L323W, L323Y, Q324A, Q324C, Q324G, Q324P, Y325A, Y325C, Y325D, Y325E, Y325G, Y325H, Y325K, Y325N, Y325P, Y325Q, Y325R, Y325S, Y325T, Y325W, L326A, L326C, L326D, L326E, L326G, L326H, L326K, L326N, L326P, L326Q, L326R, L326S, L326T, L326F, L326I, L326M, L326V, L326W, L326Y, R327A, R327C, R327G, R327H, R327P, V328A, V328C, V328D, V328E, V328G, V328H, V328K, V328N, V328P, V328Q, V328R, V328S, V328T, V328F, V328I, V328M, V328W, V328Y, L330A, L330C, L330D, L330E, L330G, L330H, L330K, L330N, L330P, L330Q, L330R, L330S, L330T, L330F, L330I, L330V, L330W, L330Y, V331A, V331C, V331D, V331E, V331G, V331H, V331K, V331N, V331P, V331Q, V331R, V331S, V331T, V331F, V331I, V331M, V331W, V331Y, D332A, D332C, D332G, D332P, R333A, R333C, R333D, R333E, R333G, R333H, R333N, R333P, R333Q, R333R, R333S, R333T, A334C, A334D, A334E, A334G, A334H, A334K, A334N, A334P, A334Q, A334R, A334S, A334T, T335A, T335C, T335G, T335P, C336D, C336E, C336H, C336K, C336N, C336P, C336Q, C336R, C336S, C336T, L337A, L337C, L337D, L337E, L337G, L337H, L337K, L337N, L337P, L337Q, L337R, L337S, L337T, R338A, R338E, R338V, R338T, R338C, R338G, R338P, R338I, R338F, R338W, R338S, S339D, S339H, K341A, K341C, K341G, K341P, F342A, F342C, F342D, F342E, F342G, F342H, F342K, F342N, F342P, F342Q, F342R, F342S, F342T, F342M, F342W, T343A, T343C, T343G, T343P, I344A, I344C, I344D, I344E, I344G, I344H, I344K, I344N, I344P, I344Q, I344R, I344S, I344T, Y345F, Y345A, Y345C, Y345D, Y345E, Y345G, Y345H, Y345K, Y345N, Y345P, Y345Q, Y345R, Y345S, Y345T, Y345M, Y345W, N346A, N346C, N346G, N346P, N347H, N347P, M348A, M348C, M348D, M348E, M348G, M348H, M348K, M348N, M348P, M348Q, M348R, M348S, M348T, F349A, F349C, F349D, F349E, F349G, F349H, F349K, F349N, F349P, F349Q, F349R, F349S, F349T, F349I, F349M, F349W, F349Y, C350D, C350H, C350P, C350T, A351E, A351H, A351N, A351P, A351Q, A351R, A351S, A351T, G352A, G352C, G352P, F353A, F353C, F353D, F353E, F353G, F353H, F353K, F353N, F353P, F353Q, F353R, F353S, F353T, F353I, F353M, F353W, H354A, H354C, H354G, H354P, E355A, E355C, E355D, E355G, E355H, E355K, E355N, E355P, E355Q, E355S, E355T, G356D, G356E, G356H, G356K, G356N, G356P, G356Q, G356S, G356T, G357D, G357E, G357H, G357K, G357N, G357P, G357Q, G357S, G357T, R358D, R358E, R358H, R358K, R358N, R358P, R358Q, R358R, R358S, R358T, D359A, D359C, D359G, D359P, D359Q, D359S, D359T, S360A, S360C, S360G, S360P, C361D, C361E, C361H, C361K, C361N, C361P, C361Q, C361R, C361S, C361T, V370A, V370C, V370D, V370E, V370G, V370H, V370K, V370N, V370P, V370Q, V370R, V370S, V370T, V370W, V370Y, V373A, V373C, V373D, V373E, V373G, V373H, V373K, V373N, V373P, V373Q, V373R, V373S, V373T, V373F, V373I, V373M, V373W, E374A, E374C, E374G, E374P, G375H, S377A, S377C, S377G, S377P, F378A, F378C, F378D, F378E, F378G, F378H, F378K, F378N, F378P, F378Q, F378R, F378S, F378T, F378W, L379A, L379C, L379D, L379E, L379G, L379H, L379K, L379N, L379P, L379Q, L379R, L379S, L379T, L379I, L379M, L379W, L379Y, T380A, T380C, T380G, T380P, G381D, G381E, G381H, G381K, G381N, G381P, G381Q, G381R, G381S, G381T, I382A, I382C, I382D, I382E, I382G, I382H, I382K, I382N, I382P, I382Q, I382R, I382S, I382T, I382M, I382W, I382Y, I383A, I383C, I383D, I383E, I383H, I383K, I383N, I383P, I383Q, I383R, I383S, I383T, I383V, S384A, S384C, S384G, S384P, W385A, W385C, W385D, W385E, W385G, W385H, W385K, W385N, W385P, W385Q, W385R, W385S, W385T, W385M, E387A, E387C, E387G, E387H, E387P, E387T, E388H, E388N, E388G, E388P, E388Q, E388T, A390C, A390D, A390E, A390G, A390H, A390K, A390N, A390P, A390Q, A390R, A390S, M391A, M391C, M391D, M391E, M391G, M391H, M391K, M391N, M391P, M391Q, M391R, M391S, M391T, M391F, M391I, M391W, M391Y, K392A, K392C, K392G, K392P, G393C, G393D, G393E, G393H, G393K, G393N, G393P, G393Q, G393R, G393S, G393T, Y395A, Y395C, Y395D, Y395E, Y395G, Y395H, Y395K, Y395N, Y395P, Y395Q, Y395R, Y395S, Y395T, Y398A, Y398C, Y398D, Y398E, Y398G, Y398H, Y398K, Y398N, Y398P, Y398Q, Y398R, Y398S, Y398T, K400H, V401A, V401C, V401D, V401E, V401G, V401H, V401K, V401N, V401P, V401Q, V401R, V401S, V401T, V401F, V401I, V401M, V401W, V401Y, S402A, S402C, S402G, S402P, R403A, R403C, R403G, R403P, R403T, Y404A, Y404C, Y404D, Y404E, Y404G, Y404H, Y404K, Y404N, Y404P, Y404Q, Y404R, Y404S, Y404T, V405A, V405C, V405D, V405E, V405G, V405H, V405K, V405N, V405P, V405Q, V405R, V405S, V405T, V405W, V405Y, N406F, N406H, N406I, N406L, N406P, N406W, N406Y, W407D, W407E, W407F, W407H, W407I, W407K, W407N, W407P, W407Q, W407R, W407S, W407T, W407Y, I408D, I408E, I408H, I408K, I408N, I408P, I408Q, I408R, I408S, I408T, K409F, K409H, K409I, K409P, K409T, K409V, K409W, K409Y, E410H, K411A, K411C, K411G, K411I, K411P, K411T, K411V, K411W, K411Y, K413T, Y1I, S3Q, S3H, S3N, G4Q, G4H, G4N, K5N, K5Q, L6I, L6V, E7Q, E7H, E7N, E8Q, E8H, E8N, F9V, E15Q, E15N, R16H, R16Q, E17Q, E17H, E17N, E20Q, E20H, E20N, E21Q, E21H, E21N, K22N, K22Q, S24Q, S24N, F25V, E26Q, E26H, E26N, E27Q, E27N, R29H, R29Q, E30Q, E30N, F32I, F32V, T35Q, T35H, T35N, E36Q, E36H, E36N, R37H, R37Q, T38Q, T38H, T38N, T39Q, T39H, T39N, E40Q, E40H, E40N, F41I, F41V, K43N, K43Q, Y45I, D47N, D47Q, G48Q, G48H, G48N, D49N, E52Q, E52H, E52N, S53Q, S53N, P55A, P55S, L57V, N58Q, N58S, G59Q, G59H, G59N, G60Q, G60N, S61Q, S61H, S61N, K63N, K63Q, D64N, D64Q, D65N, D65Q, S68Q, S68H, S68N, Y69I, E70Q, E70H, E70N, P74A, P74S, F75I, F75V, G76Q, G76H, G76N, F77I, F77V, E78Q, E78H, E78N, G79Q, G79H, G79N, K80N, K80Q, E83Q, E83H, E83N, L84I, L84V, D85N, D85Q, T87Q, T87H, T87N, K91N, K91Q, N92Q, N92S, R94H, R94Q, E96Q, E96H, E96N, F98I, F98V, K100N, K100Q, S102Q, S102H, S102N, D104N, D104Q, K106N, K106Q, S110Q, S110H, S110N, T112Q, T112H, T112N, E113Q, E113N, Y115I, R116H, R116Q, L117I, L117V, E119Q, E119H, E119N, K122N, K122Q, S123Q, S123N, E125Q, E125H, E125N, P126A, P126S, A127Q, A127H, A127N, P129A, P129S, P131A, P131S, G133Q, G133H, G133N, R134Q, R134N, S136Q, S136H, S136N, S138Q, S138N, T140Q, T140N, S141Q, S141H, S141N, K142N, K142Q, T144Q, T144H, T144N, R145Q, A146Q, A146H, A146N, E147Q, E147H, E147N, T148Q, T148N, P151A, P151S, D152N, D152Q, D154N, Y155I, S158Q, S158N, T159Q, T159H, T159N, E160Q, E160H, E160N, E162Q, E162H, E162N, T163Q, T163H, T163N, L165I, L165V, D166N, D166Q, T169Q, T169H, T169N, S171Q, S171H, S171N, T172Q, T172H, T172N, S174Q, S174H, S174N, F175I, F175V, D177N, D177Q, F178I, F178V, T179Q, T179H, T179N, R180Q, E185Q, E185N, D186N, D186Q, K188N, K188Q, P189A, P189S, F192I, F192V, F192IH, P193A, P193S, W194I, L198V, N199Q, G200Q, G200H, G200N, D203Q, D203Q, F205I, G207Q, G207N, S209Q, S209H, S209N, E213Q, E213N, K214N, K214Q, T218Q, T218H, T218N, A219Q, A219N, A220Q, A220H, A220N, E224Q, E224H, E224N, T225Q, T225H, T225N, G226Q, G226H, G226N, K228N, K228Q, T230Q, T230H, T230N, E239Q, E239H, E239N, E240Q, E240N, T241Q, T241H, T241N, E242Q, E242H, E242N, T244Q, T244H, T244N, E245Q, E245H, E245N, K247N, K247Q, R248H, R248Q, R252H, R252Q, P255A, P255S, Y259I, K265N, K265Q, Y266I, L272I, L272V, E274Q, E274H, E274N, L275I, L275V, D276N, D276Q, E277Q, E277H, E277N, P278A, P278S, L279V, S283Q, S283H, S283N, Y284I, T286Q, T286H, T286N, P287A, P287S, D292N, D292Q, K293N, K293Q, E294Q, E294H, E294N, Y295I, T296Q, T296H, T296N, F299I, F299V, K301N, K301Q, F302I, F302V, G303Q, G303N, S304Q, S304H, S304N, Y306I, S308Q, S308H, S308N, G309Q, G309H, G309N, G311Q, G311N, R312H, R312Q, F314I, F314V, K316N, K316Q, R318H, R318Q, L321I, L321V, Y325I, R327Q, P329A, P329S, D332N, D332Q, T335Q, T335H, T335N, L337I, L337V, R338H, R338Q, S339Q, S339H, S339N, T340Q, T340H, T340N, K341N, K341Q, F342I, F342V, T343Q, T343H, T343N, Y345I, M348I, M348V, F349V, G352Q, G352H, G352N, F353V, D359N, S360Q, S360H, S360N, G363Q, G363H, G363N, D364N, D364Q, S365Q, S365H, S365N, G366Q, G366H, G366N, G367Q, G367H, G367N, P368A, P368S, T371Q, T371H, T371N, E372Q, E372H, E372N, E374Q, E374H, E374N, G375Q, G375N, T376Q, T376H, T376N, S377Q, S377H, S377N, F378I, F378V, L379V, T380Q, T380H, T380N, S384Q, S384H, S384N, G386Q, G386H, G386N, E387Q, E387N, M391V, K392N, K392Q, K394N, K394Q, Y395I, G396Q, G396H, G396N, I397Q, I397H, I397N, Y398I, T399Q, T399H, T399N, K400N, K400Q, S402Q, S402H, S402N, R403H, R403Q, Y404I, K409N, K409Q, E410Q, E410N, K411N, K411Q, T412Q, T412H, T412N, K413N, K413Q, L414I, L414V, T415Q, T415H, T415N, R252A, H268A, K293A, K400A, R403A, R403E and K411A.

In some instances, the modified FIX polypeptides provided herein exhibit increased resistance to antithrombin III, heparin and/or the AT-III/heparin complex compared with the unmodified FIX polypeptide. For example, the modified FIX polypeptides can exhibit at least or about 1%, 2%, 3%, 4%, 5%, 6%, 7%, 8%, 9%, 10%, 20%, 30%, 40%, 50%, 60%, 70%, 80%, 90%, 91%, 92%, 93%, 94%, 95%, 96%, 97%, 98%, 99%, 100%, 200%, 300%, 400%, 500% or more increased resistance to antithrombin III and/or heparin compared with the unmodified FIX polypeptide. In further instances, the modified FIX polypeptides exhibit increased catalytic activity compared with the unmodified FIX polypeptide. This can be in the presence or absence of FVIIIa. For example, the modified FIX polypeptides can exhibit at least or about 1%, 2%, 3%, 4%, 5%, 6%, 7%, 8%, 9%, 10%, 20%, 30%, 40%, 50%, 60%, 70%, 80%, 90%, 91%, 92%, 93%, 94%, 95%, 96%, 97%, 98%, 99%, 100%, 200%, 300%, 400%, 500% or more catalytic activity compared to an unmodified FIX polypeptide.

The modified FIX polypeptides further can exhibit improved pharmacokinetic properties compared with the unmodified FIX polypeptide, such as, for example, decreased clearance (e.g. at least or about 1%, 2%, 3%, 4%, 5%, 6%, 7%, 8%, 9%, 10%, 20%, 30%, 40%, 50%, 60%, 70%, 80%, 90%, 91%, 92%, 93%, 94%, 95%, 96%, 97%, 98% or 99% of the clearance of an unmodified FIX polypeptide), altered volume of distribution (e.g. decreased by at least or about 1%, 2%, 3%, 4%, 5%, 6%, 7%, 8%, 9%, 10%, 20%, 30%, 40%, 50%, 60%, 70%, 80%, 90%, 91%, 92%, 93%, 94%, 95%, 96%, 97%, 98% or 99% of the volume of distribution of an unmodified FIX polypeptide, or increased by at least or about 1%, 2%, 3%, 4%, 5%, 6%, 7%, 8%, 9%, 10%, 20%, 30%, 40%, 50%, 60%, 70%, 80%, 90%, 91%, 92%, 93%, 94%, 95%, 96%, 97%, 98%, 99%, 100%, 200%, 300%, 400%, 500% or more of the volume of distribution of an unmodified FIX polypeptide), increased in vivo recovery (e.g. by at least or about 1%, 2%, 3%, 4%, 5%, 6%, 7%, 8%, 9%, 10%, 20%, 30%, 40%, 50%, 60%, 70%, 80%, 90%, 91%, 92%, 93%, 94%, 95%, 96%, 97%, 98%, 99%, 100%, 200%, 300%, 400%, 500% or more of the in vivo recovery of an unmodified FIX polypeptide), increased total modified FIX polypeptide exposure in vivo (e.g. increased by at least or about 1%, 2%, 3%, 4%, 5%, 6%, 7%, 8%, 9%, 10%, 20%, 30%, 40%, 50%, 60%, 70%, 80%, 90%, 91%, 92%, 93%, 94%, 95%, 96%, 97%, 98%, 99%, 100%, 200%, 300%, 400%, 500% or more of the total exposure in vivo an unmodified FIX polypeptide), increased serum half-life (e.g. by at least or about 1%, 2%, 3%, 4%, 5%, 6%, 7%, 8%, 9%, 10%, 20%, 30%, 40%, 50%, 60%, 70%, 80%, 90%, 91%, 92%, 93%, 94%, 95%, 96%, 97%, 98%, 99%, 100%, 200%, 300%, 400%, 500% or more of the serum half-life an unmodified FIX polypeptide), and/or increased mean resonance time (MRT) compared to the unmodified FIX polypeptide (e.g. increased by at least or about 1%, 2%, 3%, 4%, 5%, 6%, 7%, 8%, 9%, 10%, 20%, 30%, 40%, 50%, 60%, 70%, 80%, 90%, 91%, 92%, 93%, 94%, 95%, 96%, 97%, 98%, 99%, 100%, 200%, 300%, 400%, 500% or more of the MRT in vivo an unmodified FIX polypeptide). In some instances, wherein the improved pharmacokinetic property increased serum half-life, the serum half life is $\alpha$, $\beta$ or $\gamma$ phase.

In some instances, the modified FIX polypeptides provided herein exhibit increased procoagulant activity compared with the unmodified FIX polypeptide, such as, for example, at least or about 1%, 2%, 3%, 4%, 5%, 6%, 7%, 8%, 9%, 10%, 20%, 30%, 40%, 50%, 60%, 70%, 80%, 90%, 91%, 92%, 93%, 94%, 95%, 96%, 97%, 98%, 99%, 100%, 200%, 300%, 400%, 500% or more than the procoagulant activity of an unmodified FIX polypeptide.

In some examples, the unmodified FIX polypeptide has a sequence of amino acids set forth in SEQ ID NO:3. Thus, provided herein are modified FIX polypeptides having a sequence of amino acids set forth in any of SEQ ID NOS: 75-272). In other examples, the unmodified FIX polypeptide is a variant of the polypeptide set forth in SEQ ID NO:3, such as an allelic or species variant having 40%, 50%, 60%, 70%, 80%, 90%, 91%, 92%, 93%, 94%, 95%, 96%, 97%, 98%, or 99% sequence identity to the polypeptide set forth in SEQ ID NO: 3, excluding the modification(s).

In some instances, the provided modified FIX polypeptides are human polypeptides. In other instances, they are non-human polypeptides. In further examples, the modified FIX polypeptides are mature polypeptide. Also provided are single chain and two-chain FIX polypeptides, and active or activated FIX polypeptides. In some examples, activation is effected by proteolytic cleavage by Factor IX (FIXa) or the Tissue Factor/Factor VIIa complex.

In some examples, the provided modified FIX polypeptides have only the primary sequence modified. In other examples, a chemical modification or a post-translational modification is contained (e.g. the modified FIX polypeptides are glycosylated, carboxylated, hydroxylated, sulfated, phosphorylated, aluminated, or conjugated to a polyethylene glycol (PEG) moiety). Also provided are chimeric and fusion FIX polypeptides.

The modified FIX polypeptides provided herein can contain 1, 2, 3, 4, 5, 6, 7, 8, 9, 10 or more modifications, or 1, 2, 3, 4, 5, 6, 7, 8, 9, 10, 20, 30, 40, 50 or 60 or more modifications, so long as the polypeptide retains at least one FIX activity (e.g. Factor VIIIa binding, Factor X binding, phospholipid binding, and/or coagulant activity) of the unmodified FIX polypeptide. For example, the modified FIX polypeptide can retain at least about or 1%, 2%, 3%, 4%, 5%, 10%, 20%, 30%, 40%, 50%, 60%, 70%, 80%, 90%, 95%, 96%, 97%, 98%, 99%, 100%, 200%, 300%, 400%, 500%, or more of an activity of the unmodified FIX polypeptide. In some examples, the activities that are retained are increased compared to the unmodified FIX polypeptide. In other examples, the activities that are retained are decreased compared to the unmodified FIX polypeptide. The activities can be measured in vitro, ex vivo or in vivo.

Provided herein are nucleic acid molecules containing a sequence of nucleotides encoding any of the provided modified FIX polypeptides. Also provided are vectors containing the nucleic acid molecules. The vector can be, for example, a prokaryotic vector, viral vector (e.g. an adenovirus, an adeno-associated-virus, a retrovirus, a herpes virus, a lentivirus, a poxvirus, or a cytomegalovirus), or a eukaryotic vector (e.g. a mammalian vector). Also provided are cells containing these vectors. The cell can be, for example, a eukaryotic cell, such as a mammalian cell (e.g. baby hamster kidney cells (BHK-21) or 293 cells or CHO cells). Typically, the cell expresses the modified FIX polypeptide. Thus, also provided are modified FIX polypeptides that are produced by any of the cells provided herein.

Provided are pharmaceutical composition, containing a therapeutically effective concentration or amount of a modified FIX polypeptide provided herein, in a pharmaceutically acceptable vehicle. In some examples, the pharmaceutical composition is formulated for local, systemic, or topical administration, such as oral, nasal, pulmonary, buccal, transdermal, subcutaneous, intraduodenal, enteral, parenteral, intravenous, or intramuscular administration. In further examples, it is formulated for controlled-release or for single-dosage administration.

Provided are methods in which a subject is treated by administering the provided pharmaceutical compositions, wherein the subject has a disease or condition that is treated by administration of FIX or a procoagulant. In some instances, the disease or condition is treated by administration of active FIX (FIXa) or FIX that is not activated. In some examples, treatment with the pharmaceutical composition ameliorates or alleviates the symptoms associated with the disease or condition. Also provided are methods that contain a step of monitoring the subject for changes in the symptoms associated with disease or condition that is treated by administration of FIX or a procoagulant.

The disease or condition to be treated using the methods can be selected from among blood coagulation disorders, hematologic disorders, hemorrhagic disorders, hemophilias, and bleeding disorders. In some examples, the hemophilia is hemophilia B. The methods also can involve administering one or more additional coagulation factors, such as, for example, plasma purified or recombinant coagulation factors, procoagulants, such as vitamin K, vitamin K derivative and protein C inhibitors, plasma, platelets, red blood cells or corticosteroids.

Also provided are articles of manufacture, containing packaging material and a pharmaceutical composition containing a provided modified FIX polypeptide contained within the packaging material. The modified FIX polypeptide is effective for treatment of a disease treatable by administration of FIX or a procoagulant, and the packaging material includes a label that indicates that the modified FIX polypeptide is used for treatment of a disease treatable by administration of FIX or a procoagulant.

Kits containing any of the pharmaceutical compositions provided herein, a device for administration of the composition and, optionally, instructions for administration also are provided.

BRIEF DESCRIPTION OF THE FIGURES

FIG. 1 depicts the coagulation cascade. The figure shows the intrinsic pathway and the extrinsic pathway of coagulation for the independent production of FXa and convergence of the pathways to a common pathway to generate thrombin and fibrin for the formation of a clot. These pathways are interconnected. The figure depicts the order of molecules involved in the activation cascade in which a zymogen is converted to an activated protease by cleavage of one or more peptide bonds. The activated protease then serves as the activating protease for the next zymogen molecule in the cascade, ultimately resulting in clot formation.

FIG. 2 depicts the cell based model of coagulation (see e.g. Hoffman et al. (2001) Thromb Haemost 85:958-965). The figure depicts the coagulation events as being separated into three phases, where initiation of coagulation is effected by the activation of FX to FXa by the TF/FVIIa complex on the TF-bearing cell, resulting in the generation of a small amount of thrombin after activation by FXa/FVa. Amplification takes place when thrombin binds to and activates the platelets, and initiates the activation of sufficient quantities of the appropriate coagulation factors to form the FVIIIa/FIXa and FVa/FXa complexes. Propagation of coagulation occurs on the surface of large numbers of activated platelets at the site of injury, resulting in a burst of thrombin generation that is sufficiently large to generate enough fibrin from fibrinogen to establish a clot at the site of injury.

FIGS. 3A-3D are an alignment of various Factor IX polypeptides, including species variants and modified Factor IX polypeptides (SEQ ID NOS:2-5, 14, 20, 172, 267, 247, 325, 346-347, 360, 365-366, 406). Also included are SEQ ID NO:6 from U.S. Pat. No. 7,700,734 containing mutations V86A/E277A/R338A and SEQ ID NO:2 from U.S. Pat. No. 7,125,841. A "*" means that the residues or nucleotides in that column are identical in all sequences in the alignment, a ":" means that conserved substitutions have been observed, and a "." means that semi-conserved substitutions are observed. As described herein, residues corresponding to positions in SEQ ID NO:3 can be determined by alignment with SEQ ID NO:3. Residues corresponding to Y155, R318, R338, T343, R403 and E410 are indicated in boxed text.

DETAILED DESCRIPTION

Outline
A. Definitions
B. Hemostasis and Role of Factor IX Therein
  1. Platelet adhesion and aggregation
  2. Coagulation cascade
    a. Initiation
    b. Amplification
    c. Propagation
  3. Regulation of Coagulation
C. Factor IX (FIX) Structure and Function
  1. FIX structure
  2. FIX post-translational modification
  3. FIX activation
  4. FIX function
  5. FIX as a biopharmaceutical
D. Modified FIX polypeptides
  1. Exemplary Amino Acid Replacements
    a. Altered glycosylation
      i. Advantages of glycosylation
      ii. Exemplary modified FIX polypeptides with altered glycosylation
        (a). Introduction of non-native glycosylation site(s)
        (b). Elimination of native glycosylation sites
    b. Increased resistance to AT-III and heparin
      i. AT-III
      ii. Heparin
      iii. Exemplary FIX polypeptides with increased resistance to AT-III and heparin
    c. Mutations to increase catalytic activity
    d. Mutations to decrease LRP binding
    e. Other mutations to alter posttranslational modification
  2. Combination modifications
    a. Modifications to increase activity
    b. Modifications that increase affinity for phospholipids or reduce binding to collagen
    c. Additional modifications to increase resistance to inhibitors
    d. Additional modifications to alter glycosylation
    e. Modifications to increase resistance to proteases
    f. Modifications to reduce immunogenicity
    g. Exemplary combination modifications
  3. Conjugates and fusion proteins
E. Production of FIX polypeptides
  1. Vectors and Cells
  2. Expression systems
    a. Prokaryotic expression
    b. Yeast
    c. Insects and insect cells
    d. Mammalian cells
    e. Plants
  3. Purification
  3. Fusion Proteins
  4. Polypeptide modification
  5. Nucleotide sequences
F. Assessing modified FIX polypeptide activities
  1. In vitro assays
    a. Glycosylation
    b. Other post-translational modifications
    c. Proteolytic activity
    d. Coagulation activity
    e. Binding to and/or inhibition by other proteins and molecules
    e. Phospholipid affinity
  2. Non-human animal models
  3. Clinical Assays
G. Formulation and Administration
  1. Formulations
    a. Dosages
    b. Dosage forms
  2. Administration of modified FIX polypeptides
  3. Administration of nucleic acids encoding modified FIX polypeptides (gene therapy)
H. Therapeutic Uses
  Hemophilia
    a. Hemophilia B
    b. Hemophilia A
J. Combination Therapies
K. Articles of manufacture and kits
L. Examples A. Definitions Unless defined otherwise, all technical and scientific terms used herein have the same meaning as is commonly understood by one of skill in the art to which the invention(s) belong. All patents, patent applications, published applications and publications, Genbank sequences, databases, websites and other published materials referred to throughout the entire disclosure herein, unless noted otherwise, are incorporated by reference in their entirety. In the event that there are a plurality of definitions for terms herein, those in this section prevail. Where reference is made to a URL or other such identifier or address, it is understood that such identifiers can change and particular information on the internet can come and go, but equivalent information can be found by searching the internet. Reference thereto evidences the availability and public dissemination of such information.

As used herein, coagulation pathway or coagulation cascade refers to the series of activation events that leads to the formation of an insoluble fibrin clot. In the coagulation cascade or pathway, an inactive protein of a serine protease (also called a zymogen) is converted to an active protease by cleavage of one or more peptide bonds, which then serves as the activating protease for the next zymogen molecule in the cascade. In the final proteolytic step of the cascade, fibrinogen is proteolytically cleaved by thrombin to fibrin, which is then crosslinked at the site of injury to form a clot.

As used herein, "hemostasis" refers to the stopping of bleeding or blood flow in an organ or body part. The term hemostasis can encompass the entire process of blood clotting to prevent blood loss following blood vessel injury to subsequent dissolution of the blood clot following tissue repair.

As used herein, "clotting" or "coagulation" refers to the formation of an insoluble fibrin clot, or the process by which the coagulation factors of the blood interact in the coagulation cascade, ultimately resulting in the formation of an insoluble fibrin clot.

As used herein, a "protease" is an enzyme that catalyzes the hydrolysis of covalent peptidic bonds. These designations include zymogen forms and activated single-, two- and multiple-chain forms thereof. For clarity, reference to proteases refer to all forms. Proteases include, for example, serine proteases, cysteine proteases, aspartic proteases, threonine and metallo-proteases depending on the catalytic activity of their active site and mechanism of cleaving peptide bonds of a target substrate.

As used herein, serine proteases or serine endopeptidases refers to a class of peptidases, which are characterized by the presence of a serine residue in the active site of the enzyme. Serine proteases participate in a wide range of functions in the body, including blood clotting and inflammation, as well as functioning as digestive enzymes in prokaryotes and eukaryotes. The mechanism of cleavage by serine proteases is based on nucleophilic attack of a targeted peptidic bond by a serine. Cysteine, threonine or water molecules associated with aspartate or metals also can play this role. Aligned side chains of serine, histidine and aspartate form a catalytic triad common to most serine proteases. The active site of serine proteases is shaped as a cleft where the polypeptide substrate binds.

As used herein, a "factor IX" or FIX polypeptide refers to any factor IX polypeptide including, but not limited to, a recombinantly produced polypeptide, a synthetically produced polypeptide and a factor IX polypeptide extracted or isolated from cells or tissues including, but not limited to, liver and blood. Alternative names that are used interchangeably for factor IX include Factor 9, Christmas factor, plasma thromboplastin component (PTC), coagulation factor IX, and serum factor IX. Abbreviations for factor IX include FIX and F9. Factor IX includes related polypeptides from different species including, but not limited to animals of human and non-human origin. Human factor IX (hFIX) includes factor IX, allelic variant isoforms (such as the allelic variant having a T148A (SEQ ID NO:20 or 325) or T412P mutation), synthetic molecules from nucleic acids, protein isolated from human tissue and cells, and modified forms thereof. Exemplary unmodified mature human factor IX polypeptides include, but are not limited to, unmodified and wild-type native factor IX polypeptides (such as the polypeptide containing a sequence set forth in SEQ ID NO:3) and the unmodified and wild-type precursor factor IX polypeptide that includes a propeptide and/or a signal peptide (such as, the precursor FIX polypeptide that has the sequence set forth in SEQ ID NO:2). One of skill in the art would recognize that the referenced positions of the mature factor IX polypeptide (SEQ ID NO:3) differ by 46 amino acid residues when compared to the precursor FIX polypeptide SEQ ID NO:2, which is the factor IX polypeptide containing the signal peptide and propeptide sequences Thus, the first amino acid residue of SEQ ID NO:3 "corresponds to" the forty-seventh ($47^{th}$) amino acid residue of SEQ ID NO:2.

The term "factor IX" also encompasses the activated form of the factor IX polypeptide, called factor IXa (FIXa), containing the FIX light chain (corresponding to amino acids 47-191 of SEQ ID NO:2, and amino acids 1-145 of SEQ ID NO:3) and FIX heavy chain (corresponding to amino acids 227-461 of SEQ ID NO:2, and amino acids 181-415 of SEQ ID NO:3) linked by a disulfide bond between residues 132C and 289C (corresponding to the mature FIX polypeptide set forth in SEQ ID NO:3). FIXa is produced from a mature FIX polypeptide (e.g. that set forth in SEQ ID NO:3) by proteolytic cleavage after amino acid residues R145 and R180. Proteolytic cleavage can be carried out, for example, by activated factor XI (FXIa) or the tissue factor/activated factor VII (TF/FVIIa) complex. The FIX polypeptides provided herein can be further modified, such as by chemical modification or post-translational modification. Such modifications include, but are not limited to, glycosylation, pegylation, albumination, farnesylation, carboxylation, hydroxylation, phosphorylation, and other polypeptide modifications known in the art.

Factor IX includes factor IX from any species, including human and non-human species. FIX polypeptides of non-human origin include, but are not limited to, murine, canine, feline, leporine, avian, bovine, ovine, porcine, equine, piscine, ranine, and other primate factor IX polypeptides. Exemplary FIX polypeptides of non-human origin include, for example, chimpanzee (*Pan troglodytes*, SEQ ID NO:4), rhesus macaque (*Macaca mulatta*, SEQ ID NO:5), mouse (*Mus musculus*, SEQ ID NO:6), rat (*Rattus norvegicus*, SEQ ID NO:7), Guinea pig (*Cavia porcellus*, SEQ ID NO:8), pig (*Sus scrofa*, SEQ ID NO:9), dog (*Canis familiaris*, SEQ ID NO:10), cat (*Felis catus*, SEQ ID NO:11), rabbit (*Oryctolagus cuniculus*, SEQ ID NO:12), chicken (*Gallus gallus*, SEQ ID NO:13), cow (*Bos Taurus*, SEQ ID NO:14), sheep (*Ovis aries*, SEQ ID NO:15), frog (*Xenopus tropicalis*, SEQ ID NO:16), zebrafish (*Danio rerio*, SEQ ID NO:17), Japanese pufferfish (*Takifugu rubripes*, SEQ ID NO:18).

Reference to FIX polypeptides also includes precursor polypeptides and mature FIX polypeptides in single-chain or two-chain forms, truncated forms thereof that have activity, and includes allelic variants and species variants, variants encoded by splice variants, and other variants, including polypeptides that have at least 40%, 45%, 50%, 55%, 65%, 70%, 75%, 80%, 85%, 90%, 95%, 96%, 97%, 98%, 99% or more sequence identity to the precursor polypeptide set forth in SEQ ID NO:2 or the mature form thereof (SEQ ID NO:3). Included are modified FIX polypeptides, such as those of SEQ ID NOS:75-272 and 326-417 and variants thereof. Also included are those that retain at least an activity of a FIX, such as FVIIIa binding, factor X binding, phospholipid binding, and/or coagulant activity of a FIX polypeptide. By retaining activity, the activity can be altered, such as reduced or increased, as compared to a wild-type FIX so long as the level of activity retained is sufficient to yield a detectable effect. FIX polypeptides include, but are not limited to, tissue-specific isoforms and allelic variants thereof, synthetic molecules prepared by translation of nucleic acids, proteins generated by chemical synthesis, such as syntheses that include ligation of shorter polypeptides, through recombinant methods, proteins isolated from human and non-human tissue and cells, chimeric FIX polypeptides and modified forms thereof. FIX polypeptides also include fragments or portions of FIX that are of sufficient length or include appropriate regions to retain at least one activity (upon activation if needed) of a full-length mature polypeptide. FIX polypeptides also include those that contain chemical or posttranslational modifications and those that do not contain chemical or posttranslational modifications. Such modifications include, but are not limited to, pegylation, albumination, glycosylation, farnesylation, carboxylation, hydroxylation, phosphorylation, and other polypeptide modifications known in the art.

As used herein, corresponding residues refers to residues that occur at aligned loci. Related or variant polypeptides are aligned by any method known to those of skill in the art. Such methods typically maximize matches, and include methods such as using manual alignments and by using the numerous alignment programs available (for example, BLASTP) and others known to those of skill in the art. By aligning the sequences of polypeptides, one skilled in the art can identify corresponding residues, using conserved and identical amino acid residues as guides. For example, by aligning the sequences of factor IX polypeptides, one of skill in the art can identify corresponding residues, using conserved and identical amino acid residues as guides. For example, the tyrosine in amino acid position 1 (Y1) of SEQ ID NO:3 (mature factor IX) corresponds to the tyrosine in amino acid position 47 (Y47) of SEQ ID NO:2. In other instances, corresponding regions can be identified. For example, the Gla domain corresponds to amino acid positions Y1 through V46 of SEQ ID NO:3, and to amino acid positions Y47 through V92 of SEQ ID NO:2. One skilled in the art also can employ conserved amino acid residues as guides to find corresponding amino acid residues between and among human and non-human sequences. For example, amino acid residues Q11 and P74 of SEQ ID NO:3 (human) correspond to R11 and Q74 of SEQ ID NO:14 (bovine). Corresponding positions also can be based on structural alignments, for example by using computer simulated alignments of protein structure. In other instances, corresponding regions can be identified.

As used herein, the same, with reference to an amino acid replacement, refers to the identical replacement at the reference amino acid position in SEQ ID NO:3 in a corresponding position in another Factor IX polypeptide. For example, the same replacement with reference to the replacement of tyrosine at amino acid residue R318 in SEQ ID NO:3 is the replacement of tyrosine at amino acid residue R319 in SEQ ID NO:14 (see, for example, FIGS. 3A-3D). For example, the same replacement with reference to the replacement of asparagine at amino acid residue E410 in SEQ ID NO:3 is the replacement of asparagine at amino acid residue S410 in SEQ ID NO:366. It is understood that reference to replacement of the same amino acid refers to replacement of amino acid residues that differ at the corresponding position from the replaced residue.

As used herein, a "proregion," "propeptide," or "pro sequence," refers to a region or a segment that is cleaved to produce a mature protein. This can include segments that function to suppress proteolytic activity by masking the catalytic machinery and thus preventing formation of the catalytic intermediate (i.e., by sterically occluding the substrate binding site). A proregion is a sequence of amino acids positioned at the amino terminus of a mature biologically active polypeptide and can be as little as a few amino acids or can be a multidomain structure.

As used herein, "mature factor IX" refers to a FIX polypeptide that lacks a signal sequence and a propeptide sequence. Typically, a signal sequence targets a protein for secretion via the endoplasmic reticulum (ER)-golgi pathway and is cleaved following insertion into the ER during translation. A propeptide sequence typically functions in post-translational modification of the protein and is cleaved prior to secretion of the protein from the cell. Thus, a mature FIX polypeptide is typically a secreted protein. In one example, a mature human FIX polypeptide is set forth in SEQ ID NO:3. The amino acid sequence set forth in SEQ ID NO:3 differs from that of the precursor polypeptide set forth in SEQ ID NO:2 in that SEQ ID NO:3 is lacking the signal sequence, which corresponds to amino acid residues 1-28 of SEQ ID NO:2, and also lacks the propeptide sequence, which corresponds to amino acid residues 29-46 of SEQ ID NO:2. Reference to a mature FIX polypeptide encompasses the single-chain zymogen form and the two-chain form. Thus, reference to a mature FIX polypeptide also refers to the two chain form containing the heavy chain and light chain (without the activation peptide corresponding to amino acids 192-226 of SEQ ID NO:2) joined by disulfide bonds.

As used herein, "wild-type" or "native" with reference to FIX refers to a FIX polypeptide encoded by a native or naturally occurring FIX gene, including allelic variants, that is present in an organism, including a human and other animals, in nature. Reference to wild-type factor IX without reference to a species is intended to encompass any species of a wild-type factor IX. Included among wild-type FIX polypeptides are the encoded precursor polypeptide, fragments thereof, and processed forms thereof, such as a mature form lacking the signal peptide as well as any pre- or post-translationally processed or modified forms thereof. Also included among native FIX polypeptides are those that are post-translationally modified, including, but not limited to, modification by glycosylation, carboxylation and hydroxylation. Native FIX polypeptides also include single-chain and two-chain forms. For example, humans express native FIX. The amino acid sequence of exemplary wild-type human FIX are set forth in SEQ ID NOS:2 and 3 and allelic variants thereof. Other animals produce native FIX, including, but not limited to, chimpanzee (*Pan troglodytes*, SEQ ID NO:4), rhesus macaque (Macaca mulatta, SEQ ID NO:5), mouse (*Mus musculus*, SEQ ID NO:6), rat (*Rattus norvegicus*, SEQ ID NO:7), Guinea pig (*Cavia porcellus*, SEQ ID NO:8), pig (*Sus scrofa*, SEQ ID NO:9), dog (*Canis familiaris*, SEQ ID NO:10), cat (*Felis catus*, SEQ ID NO:11), rabbit (*Oryctolagus cuniculus*, SEQ ID NO:12), chicken (*Gallus gallus*, SEQ ID NO:13), cow (*Bos Taurus*, SEQ ID NO:14), sheep (*Ovis aries*, SEQ ID NO:15), frog (*Xenopus tropicalis*, SEQ ID NO:16), zebrafish (*Danio rerio*, SEQ ID NO:17), Japanese pufferfish (*Takifugu rubripes*, SEQ ID NO:18).

As used herein, species variants refer to variants in polypeptides among different species, including different mammalian species, such as mouse and human.

As used herein, allelic variants refer to variations in proteins among members of the same species.

As used herein, a splice variant refers to a variant produced by differential processing of a primary transcript of genomic DNA that results in more than one type of mRNA.

As used herein, a zymogen refers to a protease that is activated by proteolytic cleavage, including maturation cleavage, such as activation cleavage, and/or complex formation with other protein(s) and/or cofactor(s). A zymogen is an inactive precursor of a proteolytic enzyme. Such precursors are generally larger, although not necessarily larger, than the active form. With reference to serine proteases, zymogens are converted to active enzymes by specific cleavage, including catalytic and autocatalytic cleavage, or by binding of an activating co-factor, which generates an active enzyme. For example, generally, zymogens are present in a single-chain form. Zymogens, generally, are inactive and can be converted to mature active polypeptides by catalytic or autocatalytic cleavage at one or more proteolytic sites to generate a multi-chain, such as a two-chain, polypeptide. A zymogen, thus, is an enzymatically inactive protein that is converted to a proteolytic enzyme by the action of an activator. Cleavage can be effected by autoactivation. A number of coagulation proteins are zymogens; they are inactive, but become cleaved and activated upon the initiation of the coagulation system following vascular damage. With reference to FIX, the FIX polypeptides exist in the blood plasma as zymogens until cleavage by proteases, such as for example, activated FXI (FXIa) or FVIIa (in association with TF) to produce the two-chain form of FIX (FIXa).

As used herein, an activation sequence refers to a sequence of amino acids in a zymogen that is the site required for activation cleavage or maturation cleavage to form an active protease. Cleavage of an activation sequence can be catalyzed autocatalytically or by activating partners.

As used herein, activation cleavage is a type of maturation cleavage, which induces a conformation change that is required for the development of full enzymatic activity. This is a classical activation pathway, for example, for serine proteases in which a cleavage generates a new N-terminus that interacts with the conserved regions of the protease, such as Asp194 in chymotrypsin, to induce conformational changes required for activity. Activation can result in production of multi-chain forms of the proteases. In some instances, single chain forms of the protease can exhibit proteolytic activity.

As used herein, "activated Factor IX" or "FIXa" refers to any two-chain form of a FIXa polypeptide. A two-chain form typically results from proteolytic cleavage, but can be produced synthetically. Activated Factor IX, thus, includes the zymogen-like two-chain form with low coagulant activity, a fully activated form that occurs upon binding to FVIIIa and FX, and mutated forms that exist in a fully activated two-chain form or undergo conformational change to a fully activated form. For example, a single-chain form of FIX polypeptide (see, e.g., SEQ ID NO:3) is proteolytically cleaved after amino acid residues R145 and R180 of the mature FIX polypeptide. The cleavage products, FIX heavy chain and FIX light chain, which are held together by a disulfide bond (between amino acid residues 132C and 289C in the FIX of SEQ ID NO:3), form the two-chain activated FIX enzyme. Proteolytic cleavage can be carried out, for example, by activated factor XIa (FXIa), and activated factor VIIa (FVIIa) in complex with TF.

As used herein, a "property" of a FIX polypeptide refers to a physical or structural property, such three-dimensional structure, pI, half-life, conformation and other such physical characteristics.

As used herein, an "activity" of a FIX polypeptide refers to any activity exhibited by a factor IX polypeptide. Such activities can be tested in vitro and/or in vivo and include, but are not limited to, coagulation or coagulant activity, pro-coagulant activity, proteolytic or catalytic activity such as to effect factor X (FX) activation; antigenicity (ability to bind to or compete with a polypeptide for binding to an anti-FIX antibody); ability to bind factor VIIIa or factor X; and/or ability to bind to phospholipids. Activity can be assessed in vitro or in vivo using recognized assays, for example, by measuring coagulation in vitro or in vivo. The results of such assays indicate that a polypeptide exhibits an activity that can be correlated to activity of the polypeptide in vivo, in which in vivo activity can be referred to as biological activity. Assays to determine functionality or activity of modified forms of FIX are known to those of skill in the art. Exemplary assays to assess the activity of a FIX polypeptide include prothromboplastin time (PT) assay or the activated partial thromboplastin time (aPTT) assay to assess coagulant activity, or chromogenic assays using synthetic substrates to assess catalytic or proteolytic activity.

As used herein, "exhibits at least one activity" or "retains at least one activity" refers to the activity exhibited by a modified FIX polypeptide as compared to an unmodified FIX polypeptide of the same form and under the same conditions. For example, a modified FIX polypeptide in a two-chain form is compared with an unmodified FIX polypeptide in a two-chain form, under the same experimental conditions, where the only difference between the two polypeptides is the modification under study. In another example, a modified FIX polypeptide in a single-chain form is compared with an unmodified FIX polypeptide in a single-chain form, under the same experimental conditions, where the only difference between the two polypeptides is the modification under study. Typically, a modified FIX polypeptide that retains or exhibits at least one activity of an unmodified FIX polypeptide of the same form retains a sufficient amount of the activity such that, when administered in vivo, the modified FIX polypeptide is therapeutically effective as a procoagulant therapeutic. Generally, for a modified FIX polypeptide to retain therapeutic efficacy as a procoagulant, the amount of activity that is retained is or is about 0.5%, 1%, 2%, 3%, 4%, 5%, 6%, 7%, 8%, 9%, 10%, 11%, 12%, 13%, 14%, 15%, 16%, 17%, 18%, 19%, 20%, 30%, 40%, 50%, 60%, 70%, 80%, 90%, 100%, 200%, 300%, 400%, 500% or more of the activity of an unmodified FIX polypeptide of the same form that displays therapeutic efficacy as a procoagulant. The amount of activity that is required to maintain therapeutic efficacy as a procoagulant can be empirically determined, if necessary. Typically, retention of 0.5% to 20%, 0.5% to 10%, 0.5% to 5% of an activity is sufficient to retain therapeutic efficacy as a procoagulant in vivo.

It is understood that the activity being exhibited or retained by a modified FIX polypeptide can be any activity, including, but not limited to, coagulation or coagulant activity, procoagulant activity; proteolytic or catalytic activity such as to effect factor X (FX) activation; antigenicity (ability to bind to or compete with a polypeptide for binding to an anti-FIX antibody); ability to bind factor VIIIa or factor X; and/or ability to bind to phospholipids. In some instances, a modified FIX polypeptide can retain an activity that is increased compared to an unmodified FIX polypeptide. In some cases, a modified FIX polypeptide can retain an activity that is decreased compared to an unmodified FIX polypeptide. Activity of a modified FIX polypeptide can be any level of percentage of activity of the unmodified polypeptide, where both polypeptides are in the same form, including but not limited to, 1% of the activity, 2%, 3%, 4%, 5%, 10%, 20%, 30%, 40%, 50%, 60%, 70%, 80%, 90%, 95%, 96%, 97%, 98%, 99%, 100%, 200%, 300%, 400%, 500%, or more activity compared to the polypeptide that does not contain the modification at issue. For example, a modified FIX polypeptide can exhibit increased or decreased activity compared to the unmodified FIX polypeptide in the same form. For example, it can retain at least about or 1%, 2%, 3%, 4%, 5%, 6%, 7%, 8%, 9%, 10%, 20%, 30%, 40%, 50%, 60%, 70%, 80%, 90%, 95%, 96%, 97%, 98% or at least 99% of the activity of the unmodified FIX polypeptide. In other embodiments, the change in activity is at least about 2 times, 3 times, 4 times, 5 times, 6 times, 7 times, 8 times, 9 times, 10 times, 20 times, 30 times, 40 times, 50 times, 60 times, 70 times, 80 times, 90 times, 100 times, 200 times, 300 times, 400 times, 500 times, 600 times, 700 times, 800 times, 900 times, 1000 times, or more times greater than unmodified FIX. The particular level to be retained is a function of the intended use of the polypeptide and can be empirically determined. Activity can be measured, for example, using in vitro or in vivo assays such as those described herein.

As used herein, "coagulation activity" or "coagulant activity" or "pro-coagulant activity" refers to the ability of a polypeptide to effect coagulation. Assays to assess coagulant activity are known to those of skill in the art, and include prothrombin time (PT) assay or the activated partial thromboplastin time (aPTT) assay.

As used herein, "catalytic activity" or "proteolytic activity" with reference to FIX refers to the ability of a FIX protein to catalyze the proteolytic cleavage of a substrate, and are used interchangeably. Assays to assess such activities are known in the art. For example, the proteolytic activity of FIX can be measured using chromogenic substrates such as Mes-D-CHD-Gly-Arg-AMC, where cleavage of the substrate is monitored by absorbance and the rate of substrate hydrolysis determined by linear regression.

As used herein, domain (typically a sequence of three or more, generally 5 or 7 or more amino acids) refers to a portion of a molecule, such as proteins or the encoding nucleic acids, that is structurally and/or functionally distinct from other portions of the molecule and is identifiable. For example, domains include those portions of a polypeptide chain that can form an independently folded structure within a protein made up of one or more structural motifs and/or that is recognized by virtue of a functional activity, such as proteolytic activity. A protein can have one, or more than one, distinct domains. For example, a domain can be identified, defined or distinguished by homology of the sequence therein to related family members, such as homology to motifs that define a protease domain or a gla domain. In another example, a domain can be distinguished by its function, such as by proteolytic activity, or an ability to interact with a biomolecule, such as DNA binding, ligand binding, and dimerization. A domain independently can exhibit a biological function or activity such that the domain independently or fused to another molecule can perform an activity, such as, for example proteolytic activity or ligand binding. A domain can be a linear sequence of amino acids or a non-linear sequence of amino acids. Many polypeptides contain a plurality of domains. Such domains are known, and can be identified by those of skill in the art. For exemplification herein, definitions are provided, but it is understood that it is well within the skill in the art to recognize particular domains by name. If needed appropriate software can be employed to identify domains.

As used herein, a protease domain is the catalytically active portion of a protease. Reference to a protease domain of a protease includes the single, two- and multi-chain forms of any of these proteins. A protease domain of a protein contains all of the requisite properties of that protein required for its proteolytic activity, such as for example, the catalytic center. In reference to FIX, the protease domain shares homology and structural feature with the chymotrypsin/trypsin family protease domains, including the catalytic triad. For example, in the mature FIX polypeptide set forth in SEQ ID NO:3, the protease domain corresponds to amino acid positions 181 to 412.

As used herein, a gamma-carboxyglutamate (Gla) domain refers to the portion of a protein, for example a vitamin K-dependent protein, that contains post-translational modifications of glutamate residues, generally most, but not all of the glutamate residues, by vitamin K-dependent carboxylation to form Gla. The Gla domain is responsible for the high-affinity binding of calcium ions and binding to negatively-charged phospholipids. Typically, the Gla domain starts at the N-terminal extremity of the mature form of vitamin K-dependent proteins and ends with a conserved aromatic residue. In a mature FIX polypeptide the Gla domain corresponds to amino acid positions 1 to 46 of the exemplary polypeptide set forth in SEQ ID NO:3. Gla domains are well known and their locus can be identified in particular polypeptides. The Gla domains of the various vitamin K-dependent proteins share sequence, structural and functional homology, including the clustering of N-terminal hydrophobic residues into a hydrophobic patch that mediates interaction with negatively charged phospholipids on the cell surface membrane. Exemplary other Gla-containing polypeptides include, but are not limited to, FVII, FX, prothrombin, protein C, protein S, osteocalcin, matrix Gla protein, Growth-arrest-specific protein 6 (Gas6), and protein Z.

As used herein, an epidermal growth factor (EGF) domain (EGF-1 or EGF-2) refers to the portion of a protein that shares sequence homology to a specific 30 to 40 amino acid portion of the epidermal growth factor (EGF) sequence. The EGF domain includes six cysteine residues that have been shown (in EGF) to be involved in disulfide bonds. The main structure of an EGF domain is a two-stranded beta-sheet followed by a loop to a C-terminal short two-stranded sheet. FIX contains two EGF domains: EGF-1 and EGF-2. These domains correspond to amino acid positions 47-83, and 84-125, respectively, of the mature FIX polypeptide set forth in SEQ ID NO:3.

As used herein, "unmodified polypeptide" or "unmodified FIX" and grammatical variations thereof refer to a starting polypeptide that is selected for modification as provided herein. The starting polypeptide can be a naturally-occurring, wild-type form of a polypeptide. In addition, the starting polypeptide can be altered or mutated, such that it differs from a native wild type isoform but is nonetheless referred to herein as a starting unmodified polypeptide relative to the subsequently modified polypeptides produced herein. Thus, existing proteins known in the art that have been modified to have a desired increase or decrease in a particular activity or property compared to an unmodified reference protein can be selected and used as the starting unmodified polypeptide. For example, a protein that has been modified from its native form by one or more single amino acid changes and possesses either an increase or decrease in a desired property, such as a change in a amino acid residue or residues to alter glycosylation, can be a target protein, referred to herein as unmodified, for further modification of either the same or a different property. Exemplary modified FIX polypeptides known in the art include any FIX polypeptide described in, for example, Schuettrumpf et al., (2005) *Blood* 105(6):2316-23; Melton et al., (2001) *Blood Coagul. Fibrinolysis* 12(4):237-43; Cheung et al., (1992) *J. Biol. Chem.* 267:20529-20531; Cheung et al., (1996) *Proc. Natl. Acad. Sci. U.S.A.* 93:11068-11073;

Hopfner et al., (1997) *EMBO J.* 16:6626-6635; Sichler et al., (2003) *J. Biol. Chem.* 278:4121-4126; Begbie et al., (2005) *Thromb. Haemost.* 94(6):1138-47; Chang, J. et al., (1998) *J. Biol. Chem.* 273(20):12089-94; Yang, L. et al., (2002) *J. Biol. Chem.* 277(52):50756-60; Yang, L. et al., (2003) *J. Biol. Chem.* 278(27):25032-8; U.S. Pat. Nos. 5,969,040, 5,621,039, 6,423,826, 7,125,841, 6,017,882, 6,531,298; U.S. Patent Publication Nos. 20030211094, 20070254840, 20080188414, 2008000422, 20080050772, 20080146494, 20080050772, 20080187955, 20040254106, 20050147618, 20080280818, 20080102115, 20080167219 and 20080214461; and International Patent Publication Nos. WO2007112005, WO2007135182, WO2008082613, WO2008119815, WO2008119815, WO2007149406, WO2007112005 and WO2004101740.

As used herein, "modified factor IX polypeptides" and "modified factor IX" refer to a FIX polypeptide that has one or more amino acid differences compared to an unmodified factor IX polypeptide. The one or more amino acid differences can be amino acid mutations such as one or more amino acid replacements (substitutions), insertions or deletions, or can be insertions or deletions of entire domains, and any combinations thereof. Typically, a modified FIX polypeptide has one or more modifications in primary sequence compared to an unmodified FIX polypeptide. For example, a modified FIX polypeptide provided herein can have 1, 2, 3, 4, 5, 6, 7, 8, 9, 10, 11, 12, 13, 14, 15, 16, 17, 18, 19, 20, 30, 40, 50 or more amino acid differences compared to an unmodified FIX polypeptide. Any modification is contemplated as long as the resulting polypeptide exhibits at least one FIX activity associated with a native FIX polypeptide, such as, for example, catalytic activity, proteolytic activity, the ability to bind FVIIIa or the ability to bind phospholipids.

As used herein, "antithrombin III" or "AT-III" is a serine protease inhibitor (serpin). AT-III is synthesized as a precursor protein containing 464 amino acid residues (SEQ ID NO:21) that is cleaved during secretion to release a 432 amino acid mature antithrombin (SEQ ID NO:22).

As used herein, "heparin" refers to a heterogeneous group of straight-chain highly sulfated glycosaminoglycans having anticoagulant properties. Heparin can bind to AT-III to form the AT-III/heparin complex.

As used herein, "increased resistance to AT-III and/or heparin" refers to any amount of decreased sensitivity of a polypeptide, such as a modified FIX polypeptide, to the inhibitory effects of AT-III alone, heparin alone and/or the AT-III/heparin complex compared with a reference polypeptide, such as an unmodified FIX polypeptide. Increased resistance to AT-III, heparin, and/or an AT-III/heparin complex can be assayed by assessing the binding of a modified FIX polypeptide to AT-III, heparin, and/or an AT-III complex. Increased resistance also can be assayed by measuring inhibition of the catalytic or coagulant activity of a FIX polypeptide in the presence of AT-III, heparin, or an AT-III/heparin complex. Assays to determine the binding of a polypeptide to an inhibitor or the inhibition of enzymatic activity of a polypeptide by an inhibitor are known in the art. For covalent inhibitors, such as, for example, AT-III or an AT-III/heparin complex, a second order rate constant for inhibition can be measured. For non-covalent inhibitors, such as, for example, heparin, a $k_i$ can be measured. In addition, surface plasma resonance, such as on a BIAcore biosensor instrument, also can be used to measure the binding of FIX polypeptides to AT-III, heparin, and/or an AT-III/heparin complex using one or more defined conditions. However, for covalent inhibitors such as AT-III or an AT-III/heparin complex, only an on-rate can be measured using BIAcore; for non-covalent inhibitors such as heparin, both the on-rate and off-rate can be measured. Assays to determine the inhibitory effect of, for example, AT-III/heparin on FIX coagulant activity also are known in the art. For example, the ability of a modified FIX polypeptide to cleave its substrate FX in the presence or absence of AT-III/heparin can be measured, and the degree to which AT-III/heparin inhibits the reaction determined. This can be compared to the ability of an unmodified FIX polypeptide to cleave its substrate FX in the presence or absence of AT-III. Alternatively, the second order rate constant for inhibition of a FIX polypeptide can be measured and compared to the second order rate constant for inhibition of an unmodified FIX polypeptide. When comparing second order rate constants for inhibition, increased resistance to inhibition means a decreased second order rate constant of inhibition. A modified polypeptide that exhibits increased resistance to AT-III and/or heparin exhibits, for example, an increase of 1%, 2%, 3%, 4%, 5%, 6%, 7%, 8%, 9%, 10%, 20%, 30%, 40%, 50%, 60%, 70%, 80%, 90%, 91%, 92%, 93%, 94%, 95%, 96%, 97%, 98%, 99%, 100%, 200%, 300%, 400%, 500%, or more resistance to the effects of AT-III, heparin, and/or an AT-III/heparin complex, respectively, compared to an unmodified polypeptide.

As used herein, cofactors refer to proteins or molecules that bind to other specific proteins or molecules to form an active complex. In some examples, binding to a cofactor is required for optimal proteolytic activity. For example, FVIIIa is a cofactor of FIXa. Binding of FVIIIa to FIXa induces conformational changes that result in increased proteolytic activity of FIXa for its substrate, FX.

As used herein, a glycosylation site refers to an amino position in a polypeptide to which a carbohydrate moiety can be attached. Typically, a glycosylated protein contains one or more amino acid residues, such as asparagine or serine, for the attachment of the carbohydrate moieties.

As used herein, a native glycosylation site refers to the position of an amino acid to which a carbohydrate moiety is attached in a wild-type polypeptide. There are six native glycosylation sites in FIX; two N-glycosylation sites at N157 and N167, and six O-glycosylation sites at S53, S61, T159, T169, T172 and T179, corresponding to amino acid positions in the mature FIX polypeptide set forth in SEQ ID NO:3.

As used herein, a non-native glycosylation site refers to the position of an amino acid to which a carbohydrate moiety is attached in a modified polypeptide that is not present in a wild-type polypeptide. Non-native glycosylation sites can be introduced into a FIX polypeptide by amino acid replacement. O-glycosylation sites can be created, for example, by amino acid replacement of a native residue with a serine or threonine. N-glycosylation sites can be created, for example, by establishing the motif Asn-Xaa-Ser/Thr/Cys, where Xaa is not proline. Creation of this consensus sequence by amino acid modification can involve, for example, a single amino acid replacement of a native amino acid residue with an asparagine, a single amino acid replacement of a native amino acid residue with a serine, threonine or cysteine, or a double amino acid replacement involving a first amino acid replacement of a native residue with an asparagine and a second amino acid replacement of native residue with a serine, threonine or cysteine.

As used herein, "increased levels of glycosylation" and any grammatical variations thereof, refers to an increased amount of carbohydrate linked to a polypeptide as compared with a reference polypeptide or protein. The carbohydrate can be N-linked, O-linked, C-linked or be attached by any other linkage. The level of glycosylation can be increased by at least about 1%, 2%, 3%, 4%, 5%, 6%, 7%, 8%, 9%, 10%, 20%, 30%, 40%, 50%, 60%, 70%, 80%, 90%, 100%, 200%, 300%, 400%, 500%, or more compared to the level of glycosylation of an unmodified polypeptide. Assays to determine the level of glycosylation (i.e. amount of carbohydrate) of a polypeptide are known in the art. For example, the carbohydrate content or level of glycosylation can be assessed by high pH anion exchange chromatography, fluorophoreassisted carbohydrate electrophoresis (FACE), sequential exoglycosidase digestions, mass spectrometry, NMR, gel electrophoresis or any other method described herein or known in the art.

As used herein, "biological activity" refers to the in vivo activities of a compound or physiological responses that result upon in vivo administration of a compound, composition or other mixture. Biological activity, thus, encompasses therapeutic effects and pharmaceutical activity of such compounds, compositions and mixtures. Biological activities can be observed in in vitro systems designed to test or use such activities. Thus, for purposes herein a biological activity of a FIX polypeptide encompasses the coagulant activity.

As used herein, a pharmacokinetic property refers to a property related to the action of a drug or agent, such as a FIX polypeptide, in the body and in particular the rate at which drugs are absorbed, distributed, metabolized, and eliminated by the body. Pharmacokinetics can be assessed by various parameters. These include, but are not limited to, clearance, volume of distribution, in vivo recovery, total modified FIX polypeptide exposure in vivo, serum half-life, and mean resonance time (MRT). Pharmacokinetic properties of polypeptide can be assessed using methods well known in the art, such as, for example, administering the polypeptide to a human or animal model and assessing the amount of FIX in the body at various time points. The various parameters, such as clearance, volume of distribution, in vivo recovery, total modified FIX polypeptide exposure in vivo, serum half-life, and mean resonance time (MRT), are assessed using calculations well known in the art and described herein.

As used herein, "improved pharmacokinetic properties" refers to a desirable change in a pharmacokinetic property of a polypeptide, such as a modified FIX polypeptide, compared to, for example, an unmodified FIX polypeptide. The change can be an increase or a decrease.

As used herein, clearance refers to the removal of an agent, such as a polypeptide, from the body of a subject following administration. Clearance can be assessed using methods well known in the art, such as those described in Example 6. For example, assays in which a FIX polypeptide is administered to mice can be performed, and the clearance of the polypeptide from the body assessed by measuring the amount of FIX in the plasma at various time points and calculating the clearance as Dose/$AUC_{0-inf}$. Improved clearance of a modified FIX polypeptide compared to an unmodified FIX polypeptide refers to a decrease in clearance of a modified FIX polypeptide compared to an unmodified FIX polypeptide. The clearance of a modified FIX polypeptide can be decreased by at least or about 1%, 2%, 3%, 4%, 5%, 6%, 7%, 8%, 9%, 10%, 20%, 30%, 40%, 50%, 60%, 70%, 80%, 90%, 91%, 92%, 93%, 94%, 95%, 96%, 97%, 98% or 99% compared to an unmodified FIX polypeptide.

As used herein, mean resonance time (MRT) refers to the amount of time a FIX polypeptide resides in the body following administration. MRT can be assessed using methods well known in the art, such as those described in Example 6. For example, assays in which a FIX polypeptide is administered to mice can be performed, and the MRT of the polypeptide assessed by measuring the amount of FIX in the plasma at various time points and calculating the MRT as $AUMC_{0-last}$/AUC where $AUC_{0-last}$ is total area under the curve and $AUMC_{0-last}$ is the total area under the first moment-versus-time curve. Improved MRT of a modified FIX polypeptide compared to an unmodified FIX polypeptide refers to an increase in MRT of a modified FIX polypeptide compared to an unmodified FIX polypeptide. The MRT of a modified FIX polypeptide can be increased by at least or about 1%, 2%, 3%, 4%, 5%, 6%, 7%, 8%, 9%, 10%, 20%, 30%, 40%, 50%, 60%, 70%, 80%, 90%, 91%, 92%, 93%, 94%, 95%, 96%, 97%, 98%, 99%, 100%, 200%, 300%, 400%, 500% or more compared to an unmodified FIX polypeptide.

As used herein, in vivo recovery refers to the percentage of FIX polypeptide detectable in the circulation after a period of time following administration in relation to the total amount of FIX polypeptide administered. In vivo recovery can be assessed using methods well known in the art, such as those described in Example 6. For example, assays in which a FIX polypeptide is administered to mice can be performed, and the in vivo recovery of the polypeptide assessed by measuring the amount of FIX in the plasma at $C_{max}$ and comparing it to the amount of FIX administered. Improved in vivo recovery of a modified FIX polypeptide compared to an unmodified FIX polypeptide refers to an increase in in vivo recovery of a modified FIX polypeptide compared to an unmodified FIX polypeptide. The in vivo recovery of a modified FIX polypeptide can be increased by at least or about 1%, 2%, 3%, 4%, 5%, 6%, 7%, 8%, 9%, 10%, 20%, 30%, 40%, 50%, 60%, 70%, 80%, 90%, 91%, 92%, 93%, 94%, 95%, 96%, 97%, 98%, 99%, 100%, 200%, 300%, 400%, 500% or more compared to an unmodified FIX polypeptide.

As used herein, plasma half-life ($t_{1/2}$) refers the elimination half-life of a FIX polypeptide, or the time at which the plasma concentration of the FIX polypeptide has reached one half of its initial or maximal concentration following administration. Reference to plasma half-life includes plasma half-life during the α-, β-, and/or γ-phase. Plasma half-life can be assessed using methods well known in the art, such as those described in Example 6. For example, assays in which a FIX polypeptide is administered to mice can be performed, and the plasma half-life of the polypeptide assessed by measuring the amount of FIX in the plasma at various time points. The $T_{1/2\beta}$, for example, is calculated as $-\ln 2$ divided by the negative slope during the terminal phase of the log-linear plot of the plasma FIX concentration-versus-time curve. Improved plasma half-life of a modified FIX polypeptide compared to an unmodified FIX polypeptide refers to an increase in plasma half-life of a modified FIX polypeptide compared to an unmodified FIX polypeptide. The plasma half-life of a modified FIX polypeptide can be increased by at least or about 1%, 2%, 3%, 4%, 5%, 6%, 7%, 8%, 9%, 10%, 20%, 30%, 40%, 50%, 60%, 70%, 80%, 90%, 91%, 92%, 93%, 94%, 95%, 96%, 97%, 98%, 99%, 100%, 200%, 300%, 400%, 500% or more compared to an unmodified FIX polypeptide.

As used herein, exposure in vivo refers to the amount of FIX polypeptide in the circulation following administration in relation to the plasma area under the concentration-time curve, or AUC, of FIX polypeptide administered. Exposure in vivo can be assessed using methods well known in the art, such as those described in Example 6. For example, assays in which a FIX polypeptide is administered to mice can be performed, and the in vivo recovery of the polypeptide assessed by measuring the amount of FIX in the plasma at various time points (i.e., AUC) and comparing it to the amount of FIX administered. Improved exposure in vivo of a modified FIX polypeptide compared to an unmodified FIX polypeptide refers to an increase in exposure in vivo of a modified FIX polypeptide compared to an unmodified FIX polypeptide. The exposure in vivo of a modified FIX polypeptide can be increased by at least or about 1%, 2%, 3%, 4%, 5%, 6%, 7%, 8%, 9%, 10%, 20%, 30%, 40%, 50%, 60%, 70%, 80%, 90%, 91%, 92%, 93%, 94%, 95%, 96%, 97%, 98%, 99%, 100%, 200%, 300%, 400%, 500% or more compared to an unmodified FIX polypeptide.

As used herein, volume of distribution refers to the distribution of a FIX polypeptide between plasma and the rest of the body following administration. It is defined as the volume in which the amount of polypeptide would need to be uniformly distributed to produce the observed concentration of polypeptide in the plasma. Volume of distribution can be assessed using methods well known in the art, such as those described in Example 6. For example, $V_{ss}$, which is the steady state volume of distribution (calculated as MRT*Cl) and $V_z$, which is the volume of distribution based on the terminal elimination constant (β) (calculated as Cl/(ln2/$T_{1/2β}$), can be assessed in assays in which a FIX polypeptide is administered to mice, and the concentration of the FIX in the plasma is determined at various time points. Improved volume of distribution of a modified FIX polypeptide compared with an unmodified FIX polypeptide, depending on the protein's mechanism of clearance and safety profile, can refer to either an increase or a decrease in the volume of distribution of a modified FIX polypeptide. For example, in cases where the polypeptide is distributed among multiple compartments, a decreased volume of distribution of a modified FIX polypeptide could result in significantly increased drug exposure and activity in the compartment of interest (e.g., the vascular compartment versus an extravascular compartment) compared with an unmodified FIX polypeptide. In other cases, for example, when drug safety is limited by $C_{max}$, redistribution into other compartments (e.g., binding to the surface of endothelial cells) can result in a longer terminal half life and/or duration of action within the compartment of interest and an superior safety profile compared to the unmodified FIX polypeptide. The volume of distribution of a modified FIX polypeptide can be decreased by at least or about 1%, 2%, 3%, 4%, 5%, 6%, 7%, 8%, 9%, 10%, 20%, 30%, 40%, 50%, 60%, 70%, 80%, 90%, 91%, 92%, 93%, 94%, 95%, 96%, 97%, 98% or 99% compared to an unmodified FIX polypeptide. In other examples, the volume of distribution of the modified FIX polypeptide is increased by at least or about 1%, 2%, 3%, 4%, 5%, 6%, 7%, 8%, 9%, 10%, 20%, 30%, 40%, 50%, 60%, 70%, 80%, 90%, 91%, 92%, 93%, 94%, 95%, 96%, 97%, 98%, 99%, 100%, 200%, 300%, 400%, 500% or more of the volume of distribution of an unmodified FIX polypeptide.

As used herein the term "assess", and grammatical variations thereof, is intended to include quantitative and qualitative determination in the sense of obtaining an absolute value for the activity of a polypeptide, and also of obtaining an index, ratio, percentage, visual or other value indicative of the level of the activity. Assessment can be direct or indirect. For example, detection of cleavage of a substrate by a polypeptide can be by direct measurement of the product, or can be indirectly measured by determining the resulting activity of the cleaved substrate.

As used herein, "chymotrypsin numbering" refers to the amino acid numbering of a mature bovine chymotrypsin polypeptide of SEQ ID NO:19. Alignment of a protease domain of another protease, such as for example the protease domain of factor IX, can be made with chymotrypsin. In such an instance, the amino acids of factor IX that correspond to amino acids of chymotrypsin are given the numbering of the chymotrypsin amino acids. Corresponding positions can be determined by such alignment by one of skill in the art using manual alignments or by using the numerous alignment programs available (for example, BLASTP). Corresponding positions also can be based on structural alignments, for example by using computer simulated alignments of protein structure. Recitation that amino acids of a polypeptide correspond to amino acids in a disclosed sequence refers to amino acids identified upon alignment of the polypeptide with the disclosed sequence to maximize identity or homology (where conserved amino acids are aligned) using a standard alignment algorithm, such as the GAP algorithm. The corresponding chymotrypsin numbers of amino acid positions 181 to 415 of the FIX polypeptide set forth in SEQ ID NO:3 are provided in Table 1. The amino acid positions relative to the sequence set forth in SEQ ID NO:3 are in normal font, the amino acid residues at those positions are in bold, and the corresponding chymotrypsin numbers are in italics. For example, upon alignment of the mature factor IX (SEQ ID NO:3) with mature chymotrypsin (SEQ ID NO:19), the valine (V) at amino acid position 181 in factor IX is given the chymotrypsin numbering of V16. Subsequent amino acids are numbered accordingly. In one example, a glutamic acid (E) at amino acid position 213 of the mature factor IX (SEQ ID NO:3) corresponds to amino acid position E49 based on chymotrypsin numbering. Where a residue exists in a protease, but is not present in chymotrypsin, the amino acid residue is given a letter notation. For example, A95a and A95b by chymotrypsin numbering correspond to A261 and A262, respectively, by numbering relative to the mature factor IX sequence (SEQ ID NO:3).

TABLE 1

| Chymotrypsin numbering of factor IX | | | | | | | | | | | | | | |
|---|---|---|---|---|---|---|---|---|---|---|---|---|---|---|
| 181 | 182 | 183 | 184 | 185 | 186 | 187 | 188 | 189 | 190 | 191 | 192 | 193 | 194 | 195 |
| V | V | G | G | E | D | A | K | P | G | Q | F | P | W | Q |
| 16 | 17 | 18 | 19 | 20 | 21 | 22 | 23 | 24 | 25 | 26 | 27 | 28 | 29 | 30 |
| 196 | 197 | 198 | 199 | 200 | 201 | 202 | 203 | 204 | 205 | 206 | 207 | 208 | 209 | 210 |
| V | V | L | N | G | K | V | D | A | F | C | G | G | S | I |
| 31 | 32 | 33 | 34 | 35 | 37 | 38 | 39 | 40 | 41 | 42 | 43 | 44 | 45 | 46 |
| 211 | 212 | 213 | 214 | 215 | 216 | 217 | 218 | 219 | 220 | 221 | 222 | 223 | 224 | 225 |
| V | N | E | K | W | I | V | T | A | A | H | C | V | E | T |
| 47 | 48 | 49 | 50 | 51 | 52 | 53 | 54 | 55 | 56 | 57 | 58 | 59 | 60 | 60A |
| 226 | 227 | 228 | 229 | 230 | 231 | 232 | 233 | 234 | 235 | 236 | 237 | 238 | 239 | 240 |
| G | V | K | I | T | V | V | A | G | E | H | N | I | E | E |
| 61 | 62 | 63 | 64 | 65 | 66 | 67 | 68 | 69 | 70 | 71 | 72 | 73 | 74 | 75 |
| 241 | 242 | 243 | 244 | 245 | 246 | 247 | 248 | 249 | 250 | 251 | 252 | 253 | 254 | 255 |
| T | E | H | T | E | Q | K | R | N | V | I | R | I | I | P |
| 76 | 77 | 78 | 79 | 80 | 81 | 82 | 83 | 84 | 85 | 86 | 87 | 88 | 89 | 90 |

TABLE 1-continued

Chymotrypsin numbering of factor IX

| 256 | 257 | 258 | 259 | 260 | 261 | 262 | 263 | 264 | 265 | 266 | 267 | 268 | 269 | 270 |
|---|---|---|---|---|---|---|---|---|---|---|---|---|---|---|
| H | H | N | Y | N | A | A | I | N | K | Y | N | H | D | I |
| 91 | 92 | 93 | 94 | 95 | 95A | 95B | 96 | 97 | 98 | 99 | 100 | 101 | 102 | 103 |
| 271 | 272 | 273 | 274 | 275 | 276 | 277 | 278 | 279 | 280 | 281 | 282 | 283 | 284 | 285 |
| A | L | L | E | L | D | E | P | L | V | L | N | S | Y | V |
| 104 | 105 | 106 | 107 | 108 | 109 | 110 | 111 | 112 | 113 | 114 | 115 | 116 | 117 | 118 |
| 286 | 287 | 288 | 289 | 290 | 291 | 292 | 293 | 294 | 295 | 296 | 297 | 298 | 299 | 300 |
| T | P | I | C | I | A | D | K | E | Y | T | N | I | F | L |
| 119 | 120 | 121 | 122 | 123 | 124 | 125 | 126 | 127 | 128 | 129 | 129A | 129B | 130 | 131 |
| 301 | 302 | 303 | 304 | 305 | 306 | 307 | 308 | 309 | 310 | 311 | 312 | 313 | 314 | 315 |
| K | F | G | S | G | Y | V | S | G | W | G | R | V | F | H |
| 132 | 133 | 134 | 135 | 136 | 137 | 138 | 139 | 140 | 141 | 142 | 143 | 144 | 145 | 147 |
| 316 | 317 | 318 | 319 | 320 | 321 | 322 | 323 | 324 | 325 | 326 | 327 | 328 | 329 | 330 |
| K | G | R | S | A | L | V | L | Q | Y | L | R | V | P | L |
| 148 | 149 | 150 | 151 | 152 | 153 | 154 | 155 | 156 | 157 | 158 | 159 | 160 | 161 | 162 |
| 331 | 332 | 333 | 334 | 335 | 336 | 337 | 338 | 339 | 340 | 341 | 342 | 343 | 344 | 345 |
| V | D | R | A | T | C | L | R | S | T | K | F | T | I | Y |
| 163 | 164 | 165 | 166 | 167 | 168 | 169 | 170 | 171 | 172 | 173 | 174 | 175 | 176 | 177 |
| 346 | 347 | 348 | 349 | 350 | 351 | 352 | 353 | 354 | 355 | 356 | 357 | 358 | 359 | 360 |
| N | N | M | F | C | A | G | F | H | E | G | G | R | D | S |
| 178 | 179 | 180 | 181 | 182 | 183 | 184 | 184A | 185 | 186 | 187 | 188 | 188A | 189 | 190 |
| 361 | 362 | 363 | 364 | 365 | 366 | 367 | 368 | 369 | 370 | 371 | 372 | 373 | 374 | 375 |
| C | Q | G | D | S | G | G | P | H | V | T | E | V | E | G |
| 191 | 192 | 193 | 194 | 195 | 196 | 197 | 198 | 199 | 200 | 201 | 202 | 203 | 204 | 205 |
| 376 | 377 | 378 | 379 | 380 | 381 | 382 | 383 | 384 | 385 | 386 | 387 | 388 | 389 | 390 |
| T | S | F | L | T | G | I | I | S | W | G | E | E | C | A |
| 206 | 207 | 208 | 209 | 210 | 211 | 212 | 213 | 214 | 215 | 216 | 217 | 219 | 220 | 221 |
| 391 | 392 | 393 | 394 | 395 | 396 | 397 | 398 | 399 | 400 | 401 | 402 | 403 | 404 | 405 |
| M | K | G | K | Y | G | I | Y | T | K | V | S | R | Y | V |
| 221A | 222 | 223 | 224 | 225 | 226 | 227 | 228 | 229 | 230 | 231 | 232 | 233 | 234 | 235 |
| 406 | 407 | 408 | 409 | 410 | 411 | 412 | 413 | 414 | 415 | | | | | |
| N | W | I | K | E | K | T | K | L | T | | | | | |
| 236 | 237 | 328 | 239 | 240 | 241 | 242 | 243 | 244 | 245 | | | | | |

As used herein, nucleic acids include DNA, RNA and analogs thereof, including peptide nucleic acids (PNA) and mixtures thereof. Nucleic acids can be single or double-stranded. When referring to probes or primers, which are optionally labeled, such as with a detectable label, such as a fluorescent or radiolabel, single-stranded molecules are contemplated. Such molecules are typically of a length such that their target is statistically unique or of low copy number (typically less than 5, generally less than 3) for probing or priming a library. Generally a probe or primer contains at least 14, 16 or 30 contiguous nucleotides of sequence complementary to or identical to a gene of interest. Probes and primers can be 10, 20, 30, 50, 100 or more nucleic acids long.

As used herein, a peptide refers to a polypeptide that is from 2 to 40 amino acids in length.

As used herein, the amino acids that occur in the various sequences of amino acids provided herein are identified according to their known, three-letter or one-letter abbreviations (Table 2). The nucleotides which occur in the various nucleic acid fragments are designated with the standard single-letter designations used routinely in the art.

As used herein, an "amino acid" is an organic compound containing an amino group and a carboxylic acid group. A polypeptide contains two or more amino acids. For purposes herein, amino acids include the twenty naturally-occurring amino acids, non-natural amino acids and amino acid analogs (i.e., amino acids wherein the α-carbon has a side chain).

In keeping with standard polypeptide nomenclature described in *J. Biol. Chem.*, 243:3557-3559 (1968), and adopted 37 C.F.R. §§1.821-1.822, abbreviations for the amino acid residues are shown in Table 2A:

TABLE 2A

Table of Correspondence

| SYMBOL | | |
|---|---|---|
| 1-Letter | 3-Letter | AMINO ACID |
| Y | Tyr | Tyrosine |
| G | Gly | Glycine |
| F | Phe | Phenylalanine |
| M | Met | Methionine |
| A | Ala | Alanine |
| S | Ser | Serine |
| I | Ile | Isoleucine |
| L | Leu | Leucine |
| T | Thr | Threonine |
| V | Val | Valine |
| P | Pro | Proline |
| K | Lys | Lysine |
| H | His | Histidine |
| Q | Gln | Glutamine |
| E | Glu | Glutamic acid |
| Z | Glx | Glu and/or Gln |
| W | Trp | Tryptophan |
| R | Arg | Arginine |
| D | Asp | Aspartic acid |
| N | Asn | Asparagine |
| B | Asx | Asn and/or Asp |
| C | Cys | Cysteine |
| X | Xaa | Unknown or other |

It should be noted that all amino acid residue sequences represented herein by formulae have a left to right orientation in the conventional direction of amino-terminus to carboxyl-terminus. In addition, the phrase "amino acid residue" is broadly defined to include the amino acids listed in the Table of Correspondence (Table 2) and modified and unusual amino acids, such as those referred to in 37 C.F.R. §§1.821-1.822, and incorporated herein by reference. Furthermore, it should be noted that a dash at the beginning or end of an amino acid residue sequence indicates a peptide bond to a further sequence of one or more amino acid residues, to an amino-terminal group such as NH$_2$ or to a carboxyl-terminal group such as COOH.

As used herein, "naturally occurring amino acids" refer to the 20 L-amino acids that occur in polypeptides.

As used herein, "non-natural amino acid" refers to an organic compound containing an amino group and a carboxylic acid group that is not one of the naturally-occurring amino acids listed in Table 2. Non-naturally occurring amino acids thus include, for example, amino acids or analogs of amino acids other than the 20 naturally-occurring amino acids and include, but are not limited to, the D-isostereomers of amino acids. Exemplary non-natural amino acids are known to those of skill in the art and can be included in a modified factor IX polypeptide.

For purposes herein, conservative amino acid substitutions may be made in any of polypeptides and domains thereof provided that the resulting protein exhibits an activity of a FIX. Conservative amino acid substitutions, such as those set forth in Table 2B, are those that do not eliminate proteolytic activity. Suitable conservative substitutions of amino acids are known to those of skill in this art and may be made generally without altering the biological activity of the resulting molecule. Those of skill in this art recognize that, in general, single amino acid substitutions in non-essential regions of a polypeptide do not substantially alter biological activity (see, e.g., Watson et al. *Molecular Biology of the Gene,* 4th Edition, 1987, The Benjamin/Cummings Pub. co., p.224). Also included within the definition, is the catalytically active fragment of an MTSP, particularly a single chain protease portion. Conservative amino acid substitutions are made, for example, in accordance with those set forth in Table 2B as follows:

TABLE 2B

| Original residue | Conservative substitution |
| --- | --- |
| Ala (A) | Gly; Ser, Abu |
| Arg (R) | Lys, orn |
| Asn (N) | Gln; His |
| Cys (C) | Ser |
| Gln (Q) | Asn |
| Glu (E) | Asp |
| Gly (G) | Ala; Pro |
| His (H) | Asn; Gln |
| Ile (I) | Leu; Val; Met; Nle; Nva |
| Leu (L) | Ile; Val; Met; Nle; Nv |
| Lys (K) | Arg; Gln; Glu |
| Met (M) | Leu; Tyr; Ile; NLe Val |
| Ornithine | Lys; Arg |
| Phe (F) | Met; Leu; Tyr |
| Ser (S) | Thr |
| Thr (T) | Ser |
| Trp (W) | Tyr |
| Tyr (Y) | Trp; Phe |
| Val (V) | Ile; Leu; Met; Nle; Nv |

Other substitutions are also permissible and may be determined empirically or in accord with known conservative substitutions.

As used herein, a DNA construct is a single or double stranded, linear or circular DNA molecule that contains segments of DNA combined and juxtaposed in a manner not found in nature. DNA constructs exist as a result of human manipulation, and include clones and other copies of manipulated molecules.

As used herein, a DNA segment is a portion of a larger DNA molecule having specified attributes. For example, a DNA segment encoding a specified polypeptide is a portion of a longer DNA molecule, such as a plasmid or plasmid fragment, which, when read from the 5' to 3' direction, encodes the sequence of amino acids of the specified polypeptide.

As used herein, the term polynucleotide means a single- or double-stranded polymer of deoxyribonucleotides or ribonucleotide bases read from the 5' to the 3' end. Polynucleotides include RNA and DNA, and can be isolated from natural sources, synthesized in vitro, or prepared from a combination of natural and synthetic molecules. The length of a polynucleotide molecule is given herein in terms of nucleotides (abbreviated "nt") or base pairs (abbreviated "bp"). The term nucleotides is used for single- and double-stranded molecules where the context permits. When the term is applied to double-stranded molecules it is used to denote overall length and will be understood to be equivalent to the term base pairs. It will be recognized by those skilled in the art that the two strands of a double-stranded polynucleotide can differ slightly in length and that the ends thereof can be staggered; thus all nucleotides within a double-stranded polynucleotide molecule can not be paired. Such unpaired ends will, in general, not exceed 20 nucleotides in length.

As used herein, "primary sequence" refers to the sequence of amino acid residues in a polypeptide.

As used herein, "similarity" between two proteins or nucleic acids refers to the relatedness between the sequence of amino acids of the proteins or the nucleotide sequences of the nucleic acids. Similarity can be based on the degree of identity and/or homology of sequences of residues and the residues contained therein. Methods for assessing the degree of similarity between proteins or nucleic acids are known to those of skill in the art. For example, in one method of assessing sequence similarity, two amino acid or nucleotide sequences are aligned in a manner that yields a maximal level of identity between the sequences. "Identity" refers to the extent to which the amino acid or nucleotide sequences are invariant. Alignment of amino acid sequences, and to some extent nucleotide sequences, also can take into account conservative differences and/or frequent substitutions in amino acids (or nucleotides). Conservative differences are those that preserve the physico-chemical properties of the residues involved. Alignments can be global (alignment of the compared sequences over the entire length of the sequences and including all residues) or local (the alignment of a portion of the sequences that includes only the most similar region or regions).

As used herein, the terms "homology" and "identity" are used interchangeably, but homology for proteins can include conservative amino acid changes. In general to identify corresponding positions the sequences of amino acids are aligned so that the highest order match is obtained (see, e.g.: *Computational Molecular Biology*, Lesk, A. M., ed., Oxford University Press, New York, 1988; *Biocomputing: Informatics and Genome Projects*, Smith, D. W., ed., Academic Press, New York, 1993; *Computer Analysis of Sequence Data, Part I*, Griffin, A. M., and Griffin, H. G., eds., Humana Press, New Jersey, 1994; *Sequence Analysis in Molecular Biology*, von Heinje, G., Academic Press, 1987; and *Sequence Analysis Primer*, Gribskov, M. and Devereux, J., eds., M Stockton Press, New York, 1991; Carillo et al. (1988) *SIAM J Applied Math* 48:1073).

As use herein, "sequence identity" refers to the number of identical amino acids (or nucleotide bases) in a comparison between a test and a reference polypeptide or polynucleotide. Homologous polypeptides refer to a pre-determined number of identical or homologous amino acid residues. Homology includes conservative amino acid substitutions as well identical residues. Sequence identity can be determined by standard alignment algorithm programs used with default gap penalties established by each supplier. Homologous nucleic acid molecules refer to a pre-determined number of identical or homologous nucleotides. Homology includes substitutions that do not change the encoded amino acid (i.e., "silent substitutions") as well identical residues. Substantially homologous nucleic acid molecules hybridize typically at moderate stringency or at high stringency all along the length of the nucleic acid or along at least about 70%, 80% or 90% of the full-length nucleic acid molecule of interest. Also contemplated are nucleic acid molecules that contain degenerate codons in place of codons in the hybridizing nucleic acid molecule. (For determination of homology of proteins, conservative amino acids can be aligned as well as identical amino acids; in this case, percentage of identity and percentage homology varies). Whether any two nucleic acid molecules have nucleotide sequences (or any two polypeptides have amino acid sequences) that are at least 80%, 85%, 90%, 95%, 96%, 97%, 98% or 99% "identical" can be determined using known computer algorithms such as the "FAST A" program, using for example, the default parameters as in Pearson et al. *Proc. Natl. Acad. Sci. USA* 85: 2444 (1988) (other programs include the GCG program package (Devereux, J., et al., *Nucleic Acids Research* 12(I): 387 (1984)), BLASTP, BLASTN, FASTA (Atschul, S. F., et al., *J. Molec. Biol.* 215:403 (1990); *Guide to Huge Computers*, Martin J. Bishop, ed., Academic Press, San Diego (1994), and Carillo et al. *SIAM J Applied Math* 48: 1073 (1988)). For example, the BLAST function of the National Center for Biotechnology Information database can be used to determine identity. Other commercially or publicly available programs include DNAStar "MegAlign" program (Madison, Wis.) and the University of Wisconsin Genetics Computer Group (UWG) "Gap" program (Madison Wis.)). Percent homology or identity of proteins and/or nucleic acid molecules can be determined, for example, by comparing sequence information using a GAP computer program (e.g., Needleman et al. *J. Mol. Biol.* 48: 443 (1970), as revised by Smith and Waterman (*Adv. Appl. Math.* 2: 482 (1981)). Briefly, a GAP program defines similarity as the number of aligned symbols (i.e., nucleotides or amino acids) which are similar, divided by the total number of symbols in the shorter of the two sequences. Default parameters for the GAP program can include: (1) a unary comparison matrix (containing a value of 1 for identities and 0 for non identities) and the weighted comparison matrix of Gribskov et al. *Nucl. Acids Res.* 14: 6745 (1986), as described by Schwartz and Dayhoff, eds., *Atlas of Protein Sequence and Structure*, National Biomedical Research Foundation, pp. 353-358 (1979); (2) a penalty of 3.0 for each gap and an additional 0.10 penalty for each symbol in each gap; and (3) no penalty for end gaps.

Therefore, as used herein, the term "identity" represents a comparison between a test and a reference polypeptide or polynucleotide. In one non-limiting example, "at least 90% identical to" refers to percent identities from 90 to 100% relative to the reference polypeptides. Identity at a level of 90% or more is indicative of the fact that, assuming for exemplification purposes a test and reference polynucleotide length of 100 amino acids are compared, no more than 10% (i.e., 10 out of 100) of amino acids in the test polypeptide differs from that of the reference polypeptides. Similar comparisons can be made between a test and reference polynucleotides. Such differences can be represented as point mutations randomly distributed over the entire length of an amino acid sequence or they can be clustered in one or more locations of varying length up to the maximum allowable, e.g., 10/100 amino acid difference (approximately 90% identity). Differences are defined as nucleic acid or amino acid substitutions, insertions or deletions. At the level of homologies or identities above about 85-90%, the result should be independent of the program and gap parameters set; such high levels of identity can be assessed readily, often without relying on software.

As used herein, it also is understood that the terms "substantially identical" or "similar" varies with the context as understood by those skilled in the relevant art, but that those of skill can assess such.

As used herein, an aligned sequence refers to the use of homology (similarity and/or identity) to align corresponding positions in a sequence of nucleotides or amino acids. Typically, two or more sequences that are related by 50% or more identity are aligned. An aligned set of sequences refers to 2 or more sequences that are aligned at corresponding positions and can include aligning sequences derived from RNAs, such as ESTs and other cDNAs, aligned with genomic DNA sequence.

As used herein, "specifically hybridizes" refers to annealing, by complementary base-pairing, of a nucleic acid molecule (e.g. an oligonucleotide) to a target nucleic acid molecule. Those of skill in the art are familiar with in vitro and in vivo parameters that affect specific hybridization, such as length and composition of the particular molecule. Parameters particularly relevant to in vitro hybridization further include annealing and washing temperature, buffer composition and salt concentration. Exemplary washing conditions for removing non-specifically bound nucleic acid molecules at high stringency are 0.1×SSPE, 0.1% SDS, 65° C., and at medium stringency are 0.2×SSPE, 0.1% SDS, 50° C. Equivalent stringency conditions are known in the art. The skilled person can readily adjust these parameters to achieve specific hybridization of a nucleic acid molecule to a target nucleic acid molecule appropriate for a particular application.

As used herein, isolated or purified polypeptide or protein or biologically-active portion thereof is substantially free of cellular material or other contaminating proteins from the cell of tissue from which the protein is derived, or substantially free from chemical precursors or other chemicals when chemically synthesized. Preparations can be determined to be substantially free if they appear free of readily detectable impurities as determined by standard methods of analysis, such as thin layer chromatography (TLC), gel electrophoresis and high performance liquid chromatography (HPLC), used by those of skill in the art to assess such purity, or sufficiently pure such that further purification would not detectably alter the physical and chemical properties, such as proteolytic and biological activities, of the substance. Methods for purification of the compounds to produce substantially chemically pure compounds are known to those of skill in the art. A substantially chemically pure compound, however, can be a mixture of stereoisomers. In such instances, further purification might increase the specific activity of the compound.

The term substantially free of cellular material includes preparations of proteins in which the protein is separated from cellular components of the cells from which it is isolated or recombinantly-produced. In one embodiment, the term substantially free of cellular material includes preparations of protease proteins having less that about 30% (by dry weight) of non-protease proteins (also referred to herein as a contaminating protein), generally less than about 20% of non-protease proteins or 10% of non-protease proteins or less that about 5% of non-protease proteins. When the protease protein or active portion thereof is recombinantly produced, it also is substantially free of culture medium, i.e., culture medium represents less than, about, or equal to 20%, 10% or 5% of the volume of the protease protein preparation.

As used herein, the term substantially free of chemical precursors or other chemicals includes preparations of protease proteins in which the protein is separated from chemical precursors or other chemicals that are involved in the synthesis of the protein. The term includes preparations of protease proteins having less than about 30% (by dry weight), 20%, 10%, 5% or less of chemical precursors or non-protease chemicals or components.

As used herein, production by recombinant methods by using recombinant DNA methods refers to the use of the well known methods of molecular biology for expressing proteins encoded by cloned DNA.

As used herein, vector (or plasmid) refers to discrete elements that are used to introduce heterologous nucleic acid into cells for either expression or replication thereof. The vectors typically remain episomal, but can be designed to effect integration of a gene or portion thereof into a chromosome of the genome. Also contemplated are vectors that are artificial chromosomes, such as bacterial artificial chromosomes, yeast artificial chromosomes and mammalian artificial chromosomes. Selection and use of such vehicles are well known to those of skill in the art.

As used herein, expression refers to the process by which nucleic acid is transcribed into mRNA and translated into peptides, polypeptides, or proteins. If the nucleic acid is derived from genomic DNA, expression can, if an appropriate eukaryotic host cell or organism is selected, include processing, such as splicing of the mRNA.

As used herein, an expression vector includes vectors capable of expressing DNA that is operatively linked with regulatory sequences, such as promoter regions, that are capable of effecting expression of such DNA fragments. Such additional segments can include promoter and terminator sequences, and optionally can include one or more origins of replication, one or more selectable markers, an enhancer, a polyadenylation signal, and the like. Expression vectors are generally derived from plasmid or viral DNA, or can contain elements of both. Thus, an expression vector refers to a recombinant DNA or RNA construct, such as a plasmid, a phage, recombinant virus or other vector that, upon introduction into an appropriate host cell, results in expression of the cloned DNA. Appropriate expression vectors are well known to those of skill in the art and include those that are replicable in eukaryotic cells and/or prokaryotic cells and those that remain episomal or those which integrate into the host cell genome.

As used herein, vector also includes "virus vectors" or "viral vectors." Viral vectors are engineered viruses that are operatively linked to exogenous genes to transfer (as vehicles or shuttles) the exogenous genes into cells.

As used herein, an adenovirus refers to any of a group of DNA-containing viruses that cause conjunctivitis and upper respiratory tract infections in humans.

As used herein, naked DNA refers to histone-free DNA that can be used for vaccines and gene therapy. Naked DNA is the genetic material that is passed from cell to cell during a gene transfer processed called transformation or transfection. In transformation or transfection, purified or naked DNA that is taken up by the recipient cell will give the recipient cell a new characteristic or phenotype.

As used herein, operably or operatively linked when referring to DNA segments means that the segments are arranged so that they function in concert for their intended purposes, e.g., transcription initiates in the promoter and proceeds through the coding segment to the terminator.

As used herein, an agent that modulates the activity of a protein or expression of a gene or nucleic acid either decreases or increases or otherwise alters the activity of the protein or, in some manner, up- or down-regulates or otherwise alters expression of the nucleic acid in a cell.

As used herein, a "chimeric protein" or "fusion protein" refers to a polypeptide operatively-linked to a different polypeptide. A chimeric or fusion protein provided herein can include one or more FIX polypeptides, or a portion thereof, and one or more other polypeptides for any one or more of a transcriptional/translational control signals, signal sequences, a tag for localization, a tag for purification, part of a domain of an immunoglobulin G, and/or a targeting agent. A chimeric FIX polypeptide also includes those having their endogenous domains or regions of the polypeptide exchanged with another polypeptide. These chimeric or fusion proteins include those produced by recombinant means as fusion proteins, those produced by chemical means, such as by chemical coupling, through, for example, coupling to sulfhydryl groups, and those produced by any other method whereby at least one polypeptide (i.e. FIX), or a portion thereof, is linked, directly or indirectly via linker(s) to another polypeptide.

As used herein, operatively-linked when referring to a fusion protein refers to a protease polypeptide and a non-protease polypeptide that are fused in-frame to one another. The non-protease polypeptide can be fused to the N-terminus or C-terminus of the protease polypeptide.

As used herein, a targeting agent, is any moiety, such as a protein or effective portion thereof, that provides specific binding to a cell surface molecule, such a cell surface receptor, which in some instances can internalize a bound conjugate or portion thereof. A targeting agent also can be one that promotes or facilitates, for example, affinity isolation or purification of the conjugate; attachment of the conjugate to a surface; or detection of the conjugate or complexes containing the conjugate.

As used herein, derivative or analog of a molecule refers to a portion derived from or a modified version of the molecule.

As used herein, "disease or disorder" refers to a pathological condition in an organism resulting from cause or condition including, but not limited to, infections, acquired conditions, genetic conditions, and characterized by identifiable symptoms. Diseases and disorders of interest herein are those involving coagulation, including those mediated by coagulation proteins and those in which coagulation proteins play a role in the etiology or pathology. Diseases and disorders also include those that are caused by the absence of a protein such as in hemophilia, and of particular interest herein are those disorders where coagulation does not occur due to a deficiency of defect in a coagulation protein.

As used herein, "procoagulant" refers to any substance that promotes blood coagulation.

As used herein, "anticoagulant" refers to any substance that inhibits blood coagulation As used herein, "hemophilia" refers to a bleeding disorder caused by a deficiency in a blood clotting factors. Hemophilia can be the result, for example, of absence, reduced expression, or reduced function of a clotting factor. The most common type of hemophilia is hemophilia A, which results from a deficiency in factor VIII. The second most common type of hemophilia is hemophilia B, which results from a deficiency in factor IX. Hemophilia C, also called FXI deficiency, is a milder and less common form of hemophilia.

As used herein, "congenital hemophilia" refers to types of hemophilia that are inherited. Congenital hemophilia results from mutation, deletion, insertion, or other modification of a clotting factor gene in which the production of the clotting factor is absent, reduced, or non-functional. For example, hereditary mutations in clotting factor genes, such as factor VIII and factor IX result in the congenital hemophilias, Hemophilia A and B, respectively.

As used herein, "acquired hemophilia" refers to a type of hemophilia that develops in adulthood from the production of autoantibodies that inactivate FVIII.

As used herein, "bleeding disorder" refers to a condition in which the subject has a decreased ability to control bleeding. Bleeding disorders can be inherited or acquired, and can result from, for example, defects or deficiencies in the coagulation pathway, defects or deficiencies in platelet activity, or vascular defects.

As used herein, "acquired bleeding disorder" refers to bleeding disorders that results from clotting deficiencies caused by conditions such as liver disease, vitamin K deficiency, or coumadin (warfarin) or other anti-coagulant therapy.

As used herein, "treating" a subject having a disease or condition means that a polypeptide, composition or other product provided herein is administered to the subject.

As used herein, a therapeutic agent, therapeutic regimen, radioprotectant, or chemotherapeutic mean conventional drugs and drug therapies, including vaccines, which are known to those skilled in the art. Radiotherapeutic agents are well known in the art.

As used herein, treatment means any manner in which the symptoms of a condition, disorder or disease are ameliorated or otherwise beneficially altered. Hence treatment encompasses prophylaxis, therapy and/or cure. Treatment also encompasses any pharmaceutical use of the compositions herein. Treatment also encompasses any pharmaceutical use of a modified FIX and compositions provided herein.

As used herein, amelioration of the symptoms of a particular disease or disorder by a treatment, such as by administration of a pharmaceutical composition or other therapeutic, refers to any lessening, whether permanent or temporary, lasting or transient, of the symptoms that can be attributed to or associated with administration of the composition or therapeutic.

As used herein, prevention or prophylaxis refers to methods in which the risk of developing disease or condition is reduced. Prophylaxis includes reduction in the risk of developing a disease or condition and/or a prevention of worsening of symptoms or progression of a disease or reduction in the risk of worsening of symptoms or progression of a disease.

As used herein an effective amount of a compound or composition for treating a particular disease is an amount that is sufficient to ameliorate, or in some manner reduce the symptoms associated with the disease. Such amount can be administered as a single dosage or can be administered according to a regimen, whereby it is effective. The amount can cure the disease but, typically, is administered in order to ameliorate the symptoms of the disease. Typically, repeated administration is required to achieve a desired amelioration of symptoms.

As used herein, "therapeutically effective amount" or "therapeutically effective dose" refers to an agent, compound, material, or composition containing a compound that is at least sufficient to produce a therapeutic effect. An effective amount is the quantity of a therapeutic agent necessary for preventing, curing, ameliorating, arresting or partially arresting a symptom of a disease or disorder.

As used herein, "patient" or "subject" to be treated includes humans and or non-human animals, including mammals. Mammals include primates, such as humans, chimpanzees, gorillas and monkeys; domesticated animals, such as dogs, horses, cats, pigs, goats, cows; and rodents such as mice, rats, hamsters and gerbils.

As used herein, a combination refers to any association between two or among more items. The association can be spatial or refer to the use of the two or more items for a common purpose.

As used herein, a composition refers to any mixture of two or more products or compounds (e.g., agents, modulators, regulators, etc.). It can be a solution, a suspension, liquid, powder, a paste, aqueous or non-aqueous formulations or any combination thereof.

As used herein, an "article of manufacture" is a product that is made and sold. As used throughout this application, the term is intended to encompass modified protease polypeptides and nucleic acids contained in articles of packaging.

As used herein, fluid refers to any composition that can flow. Fluids thus encompass compositions that are in the form of semi-solids, pastes, solutions, aqueous mixtures, gels, lotions, creams and other such compositions.

As used herein, a "kit" refers to a packaged combination, optionally including reagents and other products and/or components for practicing methods using the elements of the combination. For example, kits containing a modified protease polypeptide or nucleic acid molecule provided herein and another item for a purpose including, but not limited to, administration, diagnosis, and assessment of a biological activity or property are provided. Kits optionally include instructions for use.

As used herein, antibody includes antibody fragments, such as Fab fragments, which are composed of a light chain and the variable region of a heavy chain.

As used herein, a receptor refers to a molecule that has an affinity for a particular ligand. Receptors can be naturally-occurring or synthetic molecules. Receptors also can be referred to in the art as anti-ligands.

As used herein, animal includes any animal, such as, but not limited to; primates including humans, gorillas and monkeys; rodents, such as mice and rats; fowl, such as chickens; ruminants, such as goats, cows, deer, sheep; ovine, such as pigs and other animals. Non-human animals exclude humans as the contemplated animal. The proteases provided herein are from any source, animal, plant, prokaryotic and fungal.

As used herein, gene therapy involves the transfer of heterologous nucleic acid, such as DNA, into certain cells, target cells, of a mammal, particularly a human, with a disorder or condition for which such therapy is sought. The nucleic acid, such as DNA, is introduced into the selected target cells, such as directly or in a vector or other delivery vehicle, in a manner such that the heterologous nucleic acid, such as DNA, is expressed and a therapeutic product encoded thereby is produced. Alternatively, the heterologous nucleic acid, such as DNA, can in some manner mediate expression of DNA that encodes the therapeutic product, or it can encode a product, such as a peptide or RNA that in some manner mediates, directly or indirectly, expression of a therapeutic product. Genetic therapy also can be used to deliver nucleic acid encoding a gene product that replaces a defective gene or supplements a gene product produced by the mammal or the cell in which it is introduced. The introduced nucleic acid can encode a therapeutic compound, such as a protease or modified protease, that is not normally produced in the mammalian host or that is not produced in therapeutically effective amounts or at a therapeutically useful time. The heterologous nucleic acid, such as DNA, encoding the therapeutic product can be modified prior to introduction into the cells of the afflicted host in order to enhance or otherwise alter the product or expression thereof. Genetic therapy also can involve delivery of an inhibitor or repressor or other modulator of gene expression.

As used herein, heterologous nucleic acid is nucleic acid that is not normally produced in vivo by the cell in which it is expressed or that is produced by the cell but is at a different locus or expressed differently or that mediates or encodes mediators that alter expression of endogenous nucleic acid, such as DNA, by affecting transcription, translation, or other regulatable biochemical processes. Heterologous nucleic acid is generally not endogenous to the cell into which it is introduced, but has been obtained from another cell or prepared synthetically. Heterologous nucleic acid can be endogenous, but is nucleic acid that is expressed from a different locus or altered in its expression. Generally, although not necessarily, such nucleic acid encodes RNA and proteins that are not normally produced by the cell or in the same way in the cell in which it is expressed. Heterologous nucleic acid, such as DNA, also can be referred to as foreign nucleic acid, such as DNA. Thus, heterologous nucleic acid or foreign nucleic acid includes a nucleic acid molecule not present in the exact orientation or position as the counterpart nucleic acid molecule, such as DNA, is found in a genome. It also can refer to a nucleic acid molecule from another organism or species (i.e., exogenous).

Any nucleic acid, such as DNA, that one of skill in the art would recognize or consider as heterologous or foreign to the cell in which the nucleic acid is expressed is herein encompassed by heterologous nucleic acid; heterologous nucleic acid includes exogenously added nucleic acid that also is expressed endogenously. Examples of heterologous nucleic acid include, but are not limited to, nucleic acid that encodes traceable marker proteins, such as a protein that confers drug resistance, nucleic acid that encodes therapeutically effective substances, such as anti-cancer agents, enzymes and hormones, and nucleic acid, such as DNA, that encodes other types of proteins, such as antibodies. Antibodies that are encoded by heterologous nucleic acid can be secreted or expressed on the surface of the cell in which the heterologous nucleic acid has been introduced.

As used herein, a therapeutically effective product for gene therapy is a product that is encoded by heterologous nucleic acid, typically DNA, that, upon introduction of the nucleic acid into a host, a product is expressed that ameliorates or eliminates the symptoms, manifestations of an inherited or acquired disease or that cures the disease. Also included are biologically active nucleic acid molecules, such as RNAi and antisense.

As used herein, recitation that a polypeptide "consists essentially" of a recited sequence of amino acids means that only the recited portion, or a fragment thereof, of the full-length polypeptide is present. The polypeptide can optionally, and generally will, include additional amino acids from another source or can be inserted into another polypeptide As used herein, the singular forms "a," "an" and "the" include plural referents unless the context clearly dictates otherwise. Thus, for example, reference to compound, comprising "an extracellular domain" includes compounds with one or a plurality of extracellular domains.

As used herein, ranges and amounts can be expressed as "about" a particular value or range. About also includes the exact amount. Hence "about 5 bases" means "about 5 bases" and also "5 bases."

As used herein, "optional" or "optionally" means that the subsequently described event or circumstance does or does not occur, and that the description includes instances where said event or circumstance occurs and instances where it does not. For example, an optionally substituted group means that the group is unsubstituted or is substituted.

As used herein, the abbreviations for any protective groups, amino acids and other compounds, are, unless indicated otherwise, in accord with their common usage, recognized abbreviations, or the IUPAC-IUB Commission on Biochemical Nomenclature (see, (1972) *Biochem.* 11:1726).

B. Hemostasis And Role Of Factor Ix Therein

Provided herein are modified Factor IX (FIX) polypeptides, including modified FIXa polypeptides and catalytically active fragments thereof. Factor IX polypeptides play a role in the regulation of and process of hemostasis, and hence can be used as therapeutic agents. Effective delivery of therapeutic proteins such as FIX for clinical use is a major challenge to pharmaceutical science. Once in the blood stream, these proteins are constantly eliminated from circulation within a short time by different physiological processes, involving metabolism as well as clearance using normal pathways for protein elimination, such as (glomerular) filtration in the kidneys or proteolysis in blood. Once in the luminal gastrointestinal tract, these proteins are constantly digested by luminal proteases. The latter can be a limiting process affecting the half-life of proteins used as therapeutic agents in intravenous injection. Additionally, inhibitors in the blood can specifically inhibit the activity of the therapeutic protein. For example, antithrombin (AT-III), heparin, and the AT-III/heparin complex, can inhibit the coagulant activity of FIX. More efficacious variants of FIX with improved properties, including improved pharmacokinetic and pharmacodynamic properties, increased catalytic activity, and/or increased resistance to inhibitors, are needed.

The modified FIX polypeptides provided herein exhibit improved properties, including improved pharmacokinetic properties, such as increased serum half-life; increased resistance to inhibitors, such as antithrombin III (AT-III), heparin and the AT-III/heparin complex; increased catalytic activity; or any combination thereof. Hence, provided are modified FIX polypeptides that have increased coagulant activity. Accordingly, these polypeptides have a variety of uses and applications, for example, as therapeutics for modulating hemostasis. The following discussion provides a review of the coagulation process and the role of Factor IX in this process, before a discussion of factor IX, and modifications thereof.

Hemostasis is the physiological mechanism that stems the bleeding that results from injury to the vasculature. Normal hemostasis depends on cellular components and soluble plasma proteins, and involves a series of signaling events that ultimately leads to the formation of a blood clot. Coagulation is quickly initiated after an injury occurs to the blood vessel and endothelial cells are damaged. In the primary phase of coagulation, platelets are activated to form a haemostatic plug at the site of injury. Secondary hemostasis follows involving plasma coagulation factors, which act in a proteolytic cascade resulting in the formation of fibrin strands which strengthen the platelet plug.

Upon vessel injury, the blood flow to the immediate injured area is restricted by vascular constriction allowing platelets to adhere to the newly-exposed fibrillar collagen on the subendothelial connective tissue. This adhesion is dependent upon the von Willebrand factor (vWF), which binds to the endothelium within three seconds of injury, thereby facilitating platelet adhesion and aggregation. Activation of the aggregated platelets results in the secretion of a variety of factors, including ADP, ATP, thromboxane and serotonin. Adhesion molecules, fibrinogen, vWF, thrombospondin and fibronectin also are released. Such secretion promotes additional adhesion and aggregation of platelets, increased platelet activation and blood vessel constriction, and exposure of anionic phospholipids on the platelet surface that serve as platforms for the assembly of blood coagulation enzyme complexes. The platelets change shape leading to pseudopodia formation, which further facilitates aggregation to other platelets resulting in a loose platelet plug.

A clotting cascade of peptidases (the coagulation cascade) is simultaneously initiated. The coagulation cascade involves a series of activation events involving proteolytic cleavage. In such a cascade, an inactive protein of a serine protease (also called a zymogen) is converted to an active protease by cleavage of one or more peptide bonds, which then serves as the activating protease for the next zymogen molecule in the cascade, ultimately resulting in clot formation by the cross-linking of fibrin. For example, the cascade generates activated molecules such as thrombin (from cleavage of prothrombin), which further activates platelets, and also generates fibrin from cleavage of fibrinogen. Fibrin then forms a cross-linked polymer around the platelet plug to stabilize the clot. Upon repair of the injury, fibrin is digested by the fibrinolytic system, the major components of which are plasminogen and tissue-type plasminogen activator (tPA). Both of these proteins are incorporated into polymerizing fibrin, where they interact to generate plasmin, which, in turn, acts on fibrin to dissolve the preformed clot. During clot formation, coagulation factor inhibitors also circulate through the blood to prevent clot formation beyond the injury site. The interaction of the system, from injury to clot formation and subsequent fibrinolysis, is described below.

1. Platelet Adhesion and Aggregation

The clotting of blood is actively circumvented under normal conditions. The vascular endothelium supports vasodilation, inhibits platelet adhesion and activation, suppresses coagulation, enhances fibrin cleavage and is anti-inflammatory in character. Vascular endothelial cells secrete molecules such as nitrous oxide (NO) and prostacyclin, which inhibit platelet aggregation and dilate blood vessels. Release of these molecules activates soluble guanylate cyclases (sGC) and cGMP-dependent protein kinase I (cGKT) and increases cyclic guanosine monophosphate (cGMP) levels, which cause relaxation of the smooth muscle in the vessel wall. Furthermore, endothelial cells express cell-surface ADPases, such as CD39, which control platelet activation and aggregation by converting ADP released from platelets into adenine nucleotide platelet inhibitors. The endothelium also plays an important role in the regulation of the enzymes in the fibrinolytic cascade. Endothelial cells directly promote the generation of plasmin through the expression of receptors of plasminogen (annexin II) and urokinase, as well as the secretion of tissue-type and urokinase plasminogen activators, all of which promote clot clearance. In a final layer of prothrombotic regulation, endothelial cells play an active role in inhibiting the coagulation cascade by producing heparan sulfate, which increases the kinetics of antithrombin III inhibition of thrombin and other coagulation factors.

Under acute vascular trauma, however, vasoconstrictor mechanisms predominate and the endothelium becomes prothrombotic, procoagulatory and proinflammatory in nature. This is achieved by a reduction of endothelial dilating agents: adenosine, NO and prostacyclin; and the direct action of ADP, serotonin and thromboxane on vascular smooth muscle cells to elicit their contraction (Becker, Heindl et al. 2000). The chief trigger for the change in endothelial function that leads to the formation of haemostatic thrombus is the loss of the endothelial cell barrier between blood and extracellular matrix (ECM) components (Ruggeri (2002) Nat Med 8:1227-1234). Circulating platelets identify and discriminate areas of endothelial lesions and adhere to the exposed sub endothelium. Their interaction with the various thrombogenic substrates and locally-generated or released agonists results in platelet activation. This process is described as possessing two stages, 1) adhesion: the initial tethering to a surface, and 2) aggregation: the platelet-platelet cohesion (Savage et al. (2001) *Curr Opin Hematol* 8:270-276).

Platelet adhesion is initiated when the circulating platelets bind to exposed collagen through interaction with collagen binding proteins on the cell surface, and through interaction with vWF, also present on the endothelium. vWF protein is a multimeric structure of variable size, secreted in two directions by the endothelium; basolaterally and into the bloodstream. vWF also binds to factor VIII, which is important in the stabilization of factor VIII and its survival in the circulation.

Platelet adhesion and subsequent activation is achieved when vWF binds via its A1 domain to GPIb (part of the platelet glycoprotein receptor complex GPIb-IX-V). The interaction between vWF and GPIb is regulated by shear force such that an increase in the shear stress results in a corresponding increase in the affinity of vWF for GPIb. Integrin $\alpha 1\beta 2$, also known on leukocytes as VLA-2, is the major collagen receptor on platelets, and engagement through this receptor generates the intracellular signals that contribute to platelet activation. Binding through $\alpha 1\beta 2$ facilitates the engagement of the lower-affinity collagen receptor, GP VI. This is part of the immunoglobulin superfamily and is the receptor that generates the most potent intracellular signals for platelet activation. Platelet activation results in the release of adenosine diphosphate (ADP), which is converted to thromboxane A2.

Platelet activation also results in the surface expression of platelet glycoprotein IIIb-IIIa (GP IIb-IIIa) receptors, also known as platelet integrin $\alpha IIb\beta 3$. GP IIb-IIa receptors allow the adherence of platelets to each other (i.e. aggregation) by virtue of fibrinogen molecules linking the platelets through these receptors. This results in the formation of a platelet plug at the site of injury to help prevent further blood loss, while the damaged vascular tissue releases factors that initiate the coagulation cascade and the formation of a stabilizing fibrin mesh around the platelet plug.

2. Coagulation Cascade

The coagulation pathway is a proteolytic pathway where each enzyme is present in the plasma as a zymogen, or inactive form. Cleavage of the zymogen is regulated to release the active form from the precursor molecule. The pathway functions as a series of positive and negative feedback loops that control the activation process, where the ultimate goal is to produce thrombin, which can then convert soluble fibrinogen into fibrin to form a clot. The coagulation factors, and other proteins, participate in blood coagulation through one or more of the intrinsic, extrinsic or common pathway of coagulation. As discussed below, these pathways are interconnected, and blood coagulation likely occurs through a cell-based model of activation.

The generation of thrombin has historically been divided into three pathways, the intrinsic (suggesting that all components of the pathway are intrinsic to plasma) and extrinsic (suggesting that one or more components of the pathway are extrinsic to plasma) pathways that provide alternative routes for the generation of activated factor X (FXa), and the final common pathway which results in thrombin formation (FIG. 1). These pathways participate together in an interconnected and interdependent process to effect coagulation. A cell-based model of coagulation was developed that describes these pathways (FIG. 2) (Hoffman et al. (2001) Thromb Haemost 85:958-965). In this model, the "extrinsic" and "intrinsic" pathways are effected on different cell surfaces; the tissue factor (TF)-bearing cell and the platelet, respectively. The process of coagulation is separated into distinct phases, initiation, amplification and propagation, during which the extrinsic and intrinsic pathways function at various stages to produce the large burst of thrombin required to convert sufficient quantities of fibrinogen to fibrin for clot formation.

a. Initiation

FVII is considered to be the coagulation factor responsible for initiating the coagulation cascade, which initiation is dependent on its interaction with TF. TF is a transmembrane glycoprotein expressed by a variety of cells such as smooth muscle cells, fibroblasts, monocytes, lymphocytes, granulocytes, platelets and endothelial cells. Myeloid cells and endothelial cells only express TF when they are stimulated, such as by proinflammatory cytokines. Smooth muscle cells and fibroblasts, however, express TF constitutively. Accordingly, once these cells come in contact with the bloodstream following tissue injury, the coagulation cascade is rapidly initiated by the binding of TF with factor VII or FVIIa in the plasma. TF/FVIIa complexes can be formed by the direct binding of FVIIa to TF, or by the binding of FVII to TF and then the subsequent activation of FVII to FVIIa by a plasma protease, such as FXa, FIXa, FXIIa, or FVIIa itself. The TF/FVIIa complex remains anchored to the TF-bearing cell where it activates small amounts FX into FXa in what is known as the "extrinsic pathway" of coagulation.

The TF/FVIIa complex also cleaves small amounts of FIX into FIXa. FXa associates with its cofactor FVa to also form a complex on the TF-bearing cell that can then covert prothrombin to thrombin. The small amount of thrombin produced is, however, inadequate to support the required fibrin formation for complete clotting. Additionally, any active FXa and FIXa are inhibited in the circulation by antithrombin III (AT-III) and other serpins, which are discussed in more detail below. This would normally prevent clot formation in the circulation. In the presence of injury, however, damage to the vasculature results in platelet aggregation and activation at this site of thrombin formation, thereby allowing for amplification of the coagulation signal.

b. Amplification

Amplification takes place when thrombin binds to and activates the platelets. The activated platelets release FV from their alpha granules, which is activated by thrombin to FVa. Thrombin also releases and activates FVIII from the FVIII/vWF complex on the platelet membrane, and cleaves FXI into FXIa. These reactions generate activated platelets that have FVa, FVIIIa and FIXa on their surface, which set the stage for a large burst of thrombin generation during the propagation stage.

c. Propagation

Propagation of coagulation occurs on the surface of large numbers of platelets at the site of injury. As described above, the activated platelets have FXIa, FVIIIa and FVa on their surface. It is here that the extrinsic pathway is effected. FXIa activates FIX to FIXa, which can then bind with FVIIIa. This process, in addition to the small amounts of FIXa that is generated by cleavage of FIX by the TF/FVIIa complex on the TF-bearing cell, generates a large amount FIXa in complex with its cofactor, FVIIIa, calcium and a suitable phospholipid surface. This complex is termed the tenase or Xase complex, and it cleaves and activates the Factor X (FX) to Factor Xa (FXa). The FXa molecules bind to FVa to generate the prothrombinase complexes that activate prothrombin to thrombin. Thrombin acts in a positive feedback loop to activate even more platelets and again initiates the processes described for the amplification phase.

Very shortly, there are sufficient numbers of activated platelets with the appropriate complexes to generate the burst of thrombin that is large enough to generate sufficient amounts of fibrin from fibrinogen to form a hemostatic fibrin clot. Fibrinogen is a dimer soluble in plasma which, when cleaved by thrombin, releases fibrinopeptide A and fibrinopeptide B. Fibrinopeptide B is then cleaved by thrombin, and the fibrin monomers formed by this second proteolytic cleavage spontaneously forms an insoluble gel. The polymerized fibrin is held together by noncovalent and electrostatic forces and is stabilized by the transamidating enzyme factor XIIIa (FXIIIa), produced by the cleavage of FXIII by thrombin. Thrombin also activates TAFI, which inhibits fibrinolysis by reducing plasmin generation at the clot surface. Additionally, thrombin itself is incorporated into the structure of the clot for further stabilization. These insoluble fibrin aggregates (clots), together with aggregated platelets (thrombi), block the damaged blood vessel and prevent further bleeding.

3. Regulation of Coagulation

During coagulation, the cascade is regulated by constitutive and stimulated processes to inhibit further clot formation. Regulation is important to a) limit ischemia of tissues by fibrin clot formation, and b) prevent widespread thrombosis by localizing the clot formation only to the site of tissue injury.

Regulation is achieved by the actions of several inhibitory molecules. For example, antithrombin III (AT-III) and tissue factor pathway inhibitor (TFPI) work constitutively to inhibit factors in the coagulation cascade. TFPI predominantly inhibits FXa and FVIIa/TF complex. In contrast, which is a serine protease inhibitor (serpin), predominantly inhibits thrombin, FXa, and FIXa. The inhibition of these coagulation factors by AT-III is enhanced greatly by heparin, which binds AT-III to induce an activating conformational change that accelerates the inhibitory reaction. Heparin also can inhibit the activity of the FIXa/FVIIIa complex in an AT-III-independent manner (Yuan et al., (2005) Biochemistry 44:3615-3625). An additional factor, Protein C, which is stimulated via platelet activation, regulates coagulation by proteolytic cleavage and inactivation of FVa and FVIIIa. Protein S enhances the activity of Protein C. Further, another factor which contributes to coagulation inhibition is the integral membrane protein thrombomodulin, which is produced by vascular endothelial cells and serves as a receptor for thrombin. Binding of thrombin to thrombomodulin inhibits thrombin procoagulant activities and also contributes to protein C activation.

Fibrinolysis, the breakdown of the fibrin clot, also provides a mechanism for regulating coagulation. The crosslinked fibrin multimers in a clot are broken down to soluble polypeptides by plasmin, a serine protease. Plasmin can be generated from its inactive precursor plasminogen and recruited to the site of a fibrin clot in two ways: by interaction with tissue plasminogen activator (tPA) at the surface of a fibrin clot, and by interaction with urokinase plasminogen activator (uPA) at a cell surface. The first mechanism appears to be the major one responsible for the dissolution of clots within blood vessels. The second, although capable of mediating clot dissolution, can play a major role in tissue remodeling, cell migration, and inflammation.

Clot dissolution also is regulated in two ways. First, efficient plasmin activation and fibrinolysis occur only in complexes formed at the clot surface or on a cell membrane, while proteins free in the blood are inefficient catalysts and are rapidly inactivated. Second, plasminogen activators and plasmin are inactivated by molecules such as plasminogen activator inhibitor type 1 (PAI-1) and PAI-2 which act on the plasminogen activators, and α2-antiplasmin and β2-macroglobulin that inactivate plasmin. Under normal circumstances, the timely balance between coagulation and fibrinolysis results in the efficient formation and clearing of clots following vascular injury, while simultaneously preventing unwanted thrombotic or bleeding episodes.

C. Factor Ix (Fix) Structure And Function

Provided herein are modified FIX polypeptides with improved activities or functions. FIX is a polypeptide that is involved in the coagulation cascade. The role of FIX in the coagulation cascade is related to its structure and mechanism of activation. It is understood that the modulation of coagulation by modified FIX polypeptides provided herein also is linked to its structure and mechanism of activation. These features can be the same as an unmodified FIX polypeptide. In other cases, these features can be modified in a FIX polypeptide provided herein, thus resulting in a polypeptide with altered or improved activities or properties. For example, modification of a FIX polypeptide can alter one or more activities of a FIX polypeptide. For example, provided are modified FIX polypeptides that exhibit increased levels of glycosylation compared to a wild-type FIX polypeptide. The modified FIX polypeptides can thus exhibit improved pharmacokinetic properties, such as reduced clearance and increased serum half-life compared to a wild-type FIX polypeptide, when tested using in vivo assays. Also provided are modified FIX polypeptides that exhibit increased resistance to inhibitors, such as AT-III, heparin and the AT-III/heparin complex; and/or increased catalytic activity. Thus, provided are modified FIX polypeptides that exhibit improved therapeutic properties compared to an unmodified FIX polypeptide. A summary of structural and functional features of FIX polypeptides and modified FIX polypeptides are described below.

Factor IX is a vitamin K-dependent serine protease and is an important coagulation factor in hemostasis. It is synthesized as a single chain zymogen in the liver and circulates in the blood in this inactivated state until activated as part of the coagulation cascade. Following activation from the FIX zymogen to activated FIX (FIXa) by FXIa or the TF/FVIIa complex, FIXa binds it's cofactor, FVIIIa. The resulting FIXa/FVIIIa complex binds and activates FX to FXa, thus continuing the coagulation cascade described above to establish hemostasis. The concentration of FIX in the blood is approximately 4-5 μg/mL, and it has a half-life of approximately 18-24 hours.

Hemophilia B, also known as Christmas disease or factor IX deficiency, is caused by a deficiency or dysfunction of FIX resulting from any one or more of a variety of mutations in the FIX gene. While less prevalent than Hemophilia A, Hemophilia B remains a significant disease in which recurrent joint bleeds can lead to synovial hypertrophy, chronic synovitis, with destruction of synovium, cartilage, and bone leading to chronic pain, stiffness of the joints, and limitation of movement because of progressive severe joint damage. Recurrent muscle bleeds also produce acute pain, swelling, and limitation of movement, while bleeding at other sites can contribute to morbidity and mortality. Treatment is typically by replacement therapy with recombinant FIX (rFIX). Provided herein are modified FIX polypeptides that are designed to have increased coagulation activity upon activation, and that can serve as improved therapeutics to treat diseases and conditions amenable to factor IX therapy, such as Hemophilia B.

1. FIX Structure

The human FIX gene is located on the X chromosome and is approximately 34 kb long with eight exons. The human FIX transcript is 2803 nucleotides and contains a short 5' untranslated region, an open reading frame (including stop codon) of 1383 nucleotides and a 3' untranslated region. The 1383 nucleotide open reading frame (or FIX mRNA; SEQ ID NO:1) encodes a 461 amino acid precursor polypeptide (Swiss-Prot accession no. P00740; SEQ ID NO:2) containing a 28 amino acid N-terminal signal peptide (amino acids 1-28 of SEQ ID NO:2) that directs the factor IX polypeptide to the cellular secretory pathway. In addition the hydrophobic signal peptide, the FIX precursor polypeptide also contains an 18 amino acid propeptide (aa 29-46 of SEQ ID NO:2) that, when cleaved, releases the 415 amino acid mature polypeptide (SEQ ID NO:3) that circulates in the blood as a zymogen until activation to FIXa. In addition to the signal peptide and propeptide, the FIX precursor also contains the following segments and domains: a Gla domain (aa 47-92 of SEQ ID NO:2, corresponding to aa 1-46 of the mature FIX protein set forth in SEQ ID NO:3), epidermal growth factor (EGF)-like domain 1 (EGF1; aa 93-129 of SEQ ID NO:2, corresponding to aa 47-83 of the mature FIX protein set forth in SEQ ID NO:3), EGF2 (aa 130-171 of SEQ ID NO:2, corresponding to aa 84-125 of the mature FIX protein set forth in SEQ ID NO:3), a light chain (aa 47-191 of SEQ ID NO:2, corresponding to aa 1-145 of the mature FIX protein set forth in SEQ ID NO:3), an activation peptide (aa 192-226 of SEQ ID NO:2, corresponding to aa 146-180 of the mature FIX protein set forth in SEQ ID NO:3), a heavy chain (aa 227-461 of SEQ ID NO:2, corresponding to aa 181-415 of the mature FIX protein set forth in SEQ ID NO:3) and a serine protease domain (aa 227-459 of SEQ ID NO:2, corresponding to aa 181-413 of the mature FIX protein set forth in SEQ ID NO:3).

Like other vitamin K-dependent proteins, such as prothrombin, coagulation factors VII and X, and proteins C, S, and Z, the Gla domain of FIX is a membrane binding motif which, in the presence of calcium ions, interacts with the phospholipid membranes of cells. The vitamin K-dependent proteins require vitamin K for the posttranslational synthesis of γ-carboxyglutamic acid, an amino acid clustered in the Gla domain of these proteins. The FIX Gla domain has 12 glutamic residues, each of which are potential carboxylation sites. Many of them are, therefore, modified by carboxylation to generate γ-carboxyglutamic acid residues. There are a total of eight $Ca^{2+}$ binding sites, of both high and low affinity, in the FIX Gla domain that, when occupied by calcium ions, facilitate correct folding of the Gla domain to expose hydrophobic residues in the FIX polypeptide that are inserted into the lipid bilayer to effect binding to the membrane.

In addition to the Gla domain, the FIX polypeptide also contains two EGF-like domains. Each EGF-like domain contains six highly conserved cysteine residues that form three disulphide bonds in each domain in the same pattern observed in the EGF protein. The first EGF-like domain (EGF1) is a calcium-binding EGF domain containing a high affinity $Ca^{2+}$ binding site (Rao et al., (1995) *Cell* 82:131-141) that, when occupied by a calcium ion, contributes to the correct folding of the molecule and promotes biological activity. The second EGF domain (EGF2) does not contain a calcium binding site.

The serine protease domain, or catalytic domain, of FIX is the domain responsible for the proteolytic activity of FIXa.

Like other serine proteases, FIX contains a serine protease catalytic triad composed of H221, D269 and S365 (corresponding to H57, D102 and S195 by chymotrypsin numbering).

Activation of mature FIX to FIXa is effected by proteolytic cleavage of the R145-A146 bonds and R180-V181 bonds (numbering relative to the mature FIX polypeptide set forth in SEQ ID NO:3), releasing the activation peptide that corresponds to aa 146-180 of the mature FIX protein set forth in SEQ ID NO:3. Thus, following activation, FIXa consists of two chains; the light chain and heavy chain. The light chain contains the Gla domain, EGF1 and EGF2 domains, and the heavy chain contains the protease domain. The two chains are held together by a single disulphide bond between C132 and C289.

2. FIX Post-translational Modification

The Factor IX precursor polypeptide undergoes extensive posttranslational modification to become the mature zymogen that is secreted into the blood. Such posttranslation modifications include γ-carboxylation, β-hydroxylation, cleavage of the signal peptide and propeptide, O- and N-linked glycosylation, sulfation and phosphorylation. The N-terminal signal peptide directs the polypeptide to the endoplasmic reticulum (ER), after which it is cleaved. Immediately prior to secretion from the cell, the propeptide is cleaved by processing proteases, such as, for example, PACE/furin, that recognize at least two arginine residues within four amino acids prior to the cleavage site.

A single enzyme, vitamin K-dependent gamma-carboxylase, catalyzes the γ-carboxylation FIX in the ER (Berkner (2000) *J. Nutr.* 130:1877-80). In the carboxylation reaction, the γ-carboxylase binds to the FIX propeptide and catalyzes a second carboxylation on the γ-carbon of the glutamic acid residues (i.e. Glu to γ-carboxyglutamyl or Gla) in the Gla domain of the polypeptide. Assuming all glutamic acid residues are γ-carboxylated, FIX contains 12 Gla residues, where the first 10 are at homologous positions of other vitamin K-dependent proteins. The Gla domain of FIX then processively carboxylates all glutamates in the cluster before releasing the substrate (Morris et al. 1995; Berkner 2000; Stenina et al. 2001).

FIX also is partially β-hydroxylated. This modification is performed by a dioxygenase, which hydroxylates the β-carbon of D64 (corresponding to the mature FIX polypeptide set forth in SEQ ID NO:3) in EGF1. Approximately one third of human FIX polypeptides are β-hydroxylated. Although D64 contributes to the high affinity $Ca^{2+}$ binding site in the EGF1 domain of FIX, the hydroxylation of this residue does not appear to be necessary for $Ca^{2+}$ binding, nor for biological activity (Derian et al., (1989) *J. Biol. Chem.* 264:6615-6618, Sunnerhagen et al., (1993) *J. Biol. Chem.* 268: 23339-23344). Additional post-translational modifications include sulfonation at the tyrosine at position 155, and phosphorylation at the serine residue at position 158. These post-translational modifications of Factor IX have been implicated in contributing to in vivo recovery of FIX (Kaufman (1998) Thromb. Haemost. 79:1068-1079, U.S. Pat. No. 7,575,897).

FIX is N-linked glycosylated at asparagine residues in the activation peptide corresponding to N157 and N167 of the mature FIX polypeptide set forth in SEQ ID NO:3. Posttranslational modification also results in the serine residue at position 53 (corresponding to the mature FIX polypeptide set forth in SEQ ID NO:3) having O-linked disaccharides and trisaccharides, while the serine residue at position 61 contains an O-linked tetrasaccharide. (Nishimura et al., (1989) *J Biol. Chem.* 264:20320-20325, Harris et al., (1993) *Biochemistry* 32:6539-6547). Additionally, the threonine residues at amino acid positions 159 and 169 (corresponding to the mature FIX polypeptide set forth in SEQ ID NO:3) are O-glycosylated (Agarwala et al., (1994) *Biochemistry* 33:5167-5171). The threonine residues at amino acid positions 172 and 179 also may be O-glycosylated.

3. FIX Activation

Factor IX circulates predominantly as a zymogen with minimal proteolytic activity until it is activated by proteolytic cleavage. Activation can be effected by the TF/FVIIa complex or Factor XIa. Activation by TF/FVIIa is through the intrinsic pathway, while activation by FXIa is through the extrinsic pathway, described above. The process of activation appears to be sequential with initial cleavage of the Arg145-Ala146 bond, followed by cleavage of the Arg180-Val181 bond (Schmidt et al. (2003) Trends Cardio. Med. 13:39-45). The proteolytic cleavage releases the activation peptide, forming the two-chain FIXa molecule containing the light chain (corresponding to amino acid positions 1-145 of SEQ ID NO:3) and heavy chain (corresponding to amino acid positions 181-415 of SEQ ID NO:3) held together by a disulphide bond between the two cysteines at amino acid positions 132 and 289 (numbering corresponding to the mature FIX polypeptide set forth in SEQ ID NO:3).

At least two exosites in FX appear to be involved in binding to TF in the TF/FVIIa complex to form the FIX/TF/FVIIa ternary complex (Chen et al., (2002) Thromb. Haemost. 88:74-82). Studies suggest that the EGF1 domain of FIX is required for FIX activation by the TF/FVIIa complex. For example, mutation of G48 (relative to the mature FIX polypeptide set forth in SEQ ID NO:3) in the EGF1 domain of FIX reduces its activation by TF/FVIIa (Wu et al., (2000) *Thromb. Haemost.* 84:626-634). Further, the EGF1 domain of FIX has been shown to interact with TF in the TF/FVIIa complex (Zhong et al., (2002) *J. Biol. Chem.* 277:3622). In contrast, however, the EGF1 domain does not appear to be required for FIX activation by FXIa. The Gla domain also is involved in binding to the TF/FVIIa complex and, therefore, in activation. The Gla domain of FIX interacts with the same region in TF as FX, which also is activated by the TF/FVIIa complex (Kirchhofer et al., (2000) *Biochem.* 39:7380-7387).

Following cleavage and release of the activation peptide, a new amino terminus at V181 (corresponding to the mature FIX polypeptide set forth in SEQ ID NO:3; V16 by chymotrypsin numbering) is generated. Release of the activation peptide facilitates a conformational change whereby the amino group of V181 inserts into the active site and forms a salt bridge with the side chain carboxylate of D364. Such a change is required for conversion of the zymogen state to an active state, as the change converts the hydroxyl side chain of S365 to a reactive species that is able to hydrolyze the cleavage site of its substrate, FX. The activated FIXa polypeptide remains in a zymogen-like conformation until additional conformational changes are induced, such as by binding with FVIIIa, to generate a FIXa polypeptide with maximal catalytic activity.

4. FIX Function

FIX plays an important role in the coagulation pathway and a deficiency or absence of FIX activity leads to hemophilia B. Once activated from FIX to FIXa, FIXa in turn functions to activate the large amounts of FX to FXa that are required for coagulation. To do so, FIXa must first bind to its cofactor, Factor VIIIa, to form the FIXa/FVIIIa complex, also called the intrinsic tenase complex, on the phospholipid surface of the activated platelet. Both the Gla domain and EGF2 domain of FIX are important for stable binding to phospholipids. The FIXa/FVIIIa complex then binds FX to cleave this coagulation factor to form FIXa.

FIXa is virtually inactive in the absence of its cofactor, FVIIIa, and physiologic substrate, FX. Experimental studies indicate that this can be attributed mainly to the 99-loop. When FIXa is not bound by its cofactor, Y177 locks the 99-loop in an inactive conformation in which the side chains of Y99 and K98 (by chymotrypsin numbering, corresponding to Y266 and K265 of the mature FIX polypeptide set forth in SEQ ID NO:3) impede substrate binding. Binding of FVIIIa to FIXa unlocks and releases this zymogen-like conformation, and FX is then able to associate with the FIXa/FVIIIa complex and rearrange the unlocked 99-loop, subsequently binding to the active site cleft (Sichler et al., (2003) J. Biol. Chem. 278:4121-4126). The binding of FIXa to phospholipids and the presence of $Ca^{2+}$ further enhances the reaction.

Several models of the FIXa/FVIIIa interaction have been proposed (see e.g. Autin et al., (2005) J. Thromb. Haemost. 3:2044-2056, Stoilova-McPhie et al., (2002) Blood 99: 1215-1223, Bajaj et al., (2001) J. Biol. Chem. 276:16302-16309, Schmidt et al., (2003) Trends Cardiovasc. Med. 13:39-45). FIXa binds to FVIIIa in an interaction involving more than one domain of the FIXa polypeptide. FVIIIa is a heterodimer composed of three noncovalently associated chains: A1, A2 and A3-C1-C2. A3-C1-C2 also is referred to as the light chain. The protease domain of FIXa appears to interact with the A2 subunit of FVIIIa. Studies suggest that the 293-helix (126-helix by chymotrypsin numbering), 330-helix (162-helix by chymotrypsin numbering) and N346 (N178) by chymotrypsin numbering) of FIXa are involved in the interaction with the A2 subunit of FVIIIa. The EGF1/EGF2 domains of FIXa interact with the A3 subunit of FVIIIa. Further, it is postulated that the Gla domain of FIXa interacts with the C2 domain of FVIIIa. Calcium ions and phospholipids also contribute to binding of FIXa and FVIIIa. For example, the presence of phospholipids increases the binding of FIXa to FVIIIa by approximately 2000-fold (Mathur et al., (1997) J. Biol. Chem. 272). Following binding of FX by the FIXa/FVIIIa complex, the protease domain (or catalytic domain) of FIXa is responsible for cleavage of FX at R194-I195 to form FXa.

The activity of FIXa is regulated by inhibitory molecules, such as the AT-III/heparin complex, as discussed above, and other clearance mechanisms, such as the low-density lipoprotein receptor-related protein (LRP). LRP is a membrane glycoprotein that is expressed on a variety of tissues, including liver, brain, placenta and lung. LRP binds a wide range of proteins and complexes in addition to FIXa, including, but not limited to, apolipoproteins, lipases, proteinases, proteinase-inhibitor complexes, and matrix proteins. The zymogen or inactive form of FIX does not bind LRP. Rather, upon activation, an LRP-binding site is exposed (Neels et al., (2000) Blood 96:3459-3465). This binding site is located in a loop in the protease domain spanning residues 342 to 346 of the mature FIX polypeptide set forth in SEQ ID NO:3 (Rohlena et al., (2003) J. Biol. Chem. 278:9394-9401).

5. FIX as a Biopharmaceutical

Factor IX is integrally involved in the blood coagulation process, where, in it's activated form (FIXa), it forms a tenase complex with FVIIIa and activates FX to FXa. FXa, in conjunction with phospholipids, calcium and FVa, converts prothrombin to thrombin, which in turn cleaves fibrinogen to fibrin monomers, thus facilitating the formation of a rigid mesh clot. Many studies have demonstrated the ability of exogenous FIX to promote blood clotting in patients with hemophilia. For example, hemophilia B patients, who are deficient in FIX, can be treated by replacement therapy with exogenous FIX. Early replacement therapies utilized plasma purified FIX, such as therapeutics marketed as MonoNine® Factor IX and Alpha-nine-SD® Factor IX. Plasma purified FIX complex therapeutics also have been used, including Bebulin® VH, a purified concentrate of FIX with FX and low amounts of FVII; Konyne® 80 (Bayer), a purified concentrate of FIX, with FII, FX, and low levels of FVII; PROPLEX® T (Baxter International), a heat treated product prepared from pooled normal human plasma containing FIX with FII, FVII, and FX; and Profilnine SD® (Alpha Therapeutic Corporation). More recently, however, a human recombinant Factor IX (BeneFIX® Coagulation Factor IX (Recombinant), Wyeth) has been approved for use in the control and prevention of bleeding episodes in hemophilia B patients, including control and prevention of bleeding in surgical settings. BeneFIX® Coagulation Factor IX (Recombinant) has an amino acid sequence set forth in SEQ ID NO:20, and is identical to the Ala148 allelic form of plasma-derived Factor IX. Thus, compared to the wild-type FIX polypeptide set forth in SEQ ID NO:3, BeneFIX®, Coagulation Factor IX (Recombinant) contains a T148A mutation.

In addition to its use as a procoagulant, inactive forms of FIX, or forms with reduced catalytic activity, can be used as an anticoagulant, such as in the treatment of thrombotic diseases and conditions.

Typically, FIX is administered intravenously, but also can be administered orally, systemically, buccally, transdermally, intramuscularly and subcutaneously. FIX can be administered once or multiple times. Generally, multiple administrations are used in treatment regimens with FIX to effect coagulation.

As discussed herein below, modified FIX polypeptides provided herein also can be used in any treatment or pharmaceutical method in which an unmodified or wildtype or other therapeutically active FIX polypeptide is known to be used. In such uses, methods and processes, the modified FIX polypeptides provided herein exhibit improved properties compared to a wildtype or the unmodified FIX polypeptide.

D. Modified Fix Polypeptides

Provided herein are modified factor IX polypeptides. The FIX polypeptides can be modified by deletions, insertions or replacement (substitution) of one or more amino acid residues in the primary sequence of a wildtype or unmodified FIX polypeptide. The resulting modified polypeptides exhibit improved properties or activities compared to the unmodified or wildtype FIX polypeptide. For example, the modified factor IX polypeptides, including modified FIXa polypeptides and fragments of modified factor IX and factor IXa polypeptides, can have altered posttranslational modification, such as altered glycosylation, including hyperglycosylation, and/or altered phosphorylation or sulfation, such as decreased phosphorylation or sulfation; increased resistance to inhibitors, such as AT-III and/or heparin; decreased binding to LRP; increased catalytic activity; improved pharmacokinetic properties, including decreased clearance and increased serum half-life in vivo; increased coagulant activity; or any combination thereof. Typically, the modified FIX polypeptides exhibit procoagulant activity. Thus, provided herein are modified FIX polypeptides that exhibit increased coagulant activity upon activation from their single-chain zymogen form and subsequent binding to the cofactor, FVIIIa. Such modified FIX polypeptides can be administered to patients with diseases or conditions characterized by insufficient coagulation, such as, for example, hemophilia B.

In some examples, the modified FIX polypeptides provided herein exhibit increased resistance to inhibitors, including AT-III, heparin and the AT-III/heparin complex, compared to an unmodified FIX polypeptide. Such modified FIX polypeptides can exhibit increased coagulant activity compared to an unmodified FIX polypeptide. In further examples, the modified factor IX polypeptides provided herein exhibit altered posttranslation modification, such as altered glycosylation levels and/or altered types of glycosylation compared to an unmodified FIX polypeptide.

In some examples, the modified FIX polypeptides provided herein exhibit increased glycosylation compared to an unmodified FIX polypeptide. Thus, provided herein are hyperglycosylated FIX polypeptides. The modified FIX polypeptides can exhibit increased glycosylation by virtue of the incorporation of at least one non-native glycosylation site (i.e. a glycosylation site that is not found in the unmodified or wild-type FIX polypeptide) to which a carbohydrate moiety is linked. Such modified FIX polypeptides can exhibit improved pharmacokinetic properties in vivo, including decreased clearance and increased serum half-life. The introduction of a non-native glycosylation site and subsequent carbohydrate moiety can further improve the activity of the modified FIX polypeptide by sterically hindering the interaction of the FIX polypeptide with one or more other proteins. For example, a glycosylation site can be introduced such that when a carbohydrate moiety is attached at this site, it sterically hinders the interaction of the modified FIX polypeptide with the AT-III/heparin complex, resulting in a polypeptide with increased resistance to AT-III/heparin. This can further reduce clearance of the polypeptide from the circulation. Thus, the effects of the introduction of a new glycosylation site can be several-fold if the carbohydrate moiety also sterically hinders an interaction with another protein(s), such as the AT-III/heparin complex.

For example, the modified FIX polypeptides provided herein can contain one or more modifications that introduce one or more non-native glycosylation sites compared to the unmodified FIX polypeptide. For example, 1, 2, 3, 4, 5, 6, or more non-native glycosylation sites can be introduced. Glycosylation sites that can be introduced include, but are not limited to, N-glycosylation sites, O-glycosylation sites, or a combination thereof. Thus, when produced in a cell that facilitates glycosylation, or following in vitro glycosylation, the modified FIX polypeptides provided herein can contain 1, 2, 3, 4, 5, 6 or more carbohydrate moieties, each linked to different non-native glycosylation sites, in addition to the carbohydrate moieties linked to the native glycosylation sites (e.g. the native glycosylation sites corresponding to S53, S61, N157, N167, T159, T169, T172 and T179 of the mature FIX polypeptide set forth in SEQ ID NO:3). In a particular example, the modified FIX polypeptides provided herein contain one or more non-native N-glycosylation sites. Thus, the modified FIX polypeptides can exhibit increased levels of N-glycosylation compared to an unmodified FIX polypeptide.

The modified FIX polypeptides with increased glycosylation also can exhibit, for example, increased solubility, increased AT-III/heparin resistance, increased serum half-life, decreased immunogenicity and/or increased coagulant activity compared to an unmodified FIX polypeptide. Such modified FIX polypeptides can be used in the treatment of bleeding disorders or events, such as hemophilias or injury, where the FIX polypeptides can function to promote blood coagulation. In some instances, the modified FIX polypeptides provided herein that exhibit increased glycosylation also can contain one or more modifications that render the protein inactive, or mostly inactive. Such polypeptides, therefore, can exhibit increased anti-coagulant activity and can be used in the treatment of thrombotic events, conditions or diseases. Typically, however, the modified FIX polypeptides provided herein are procoagulants.

The modified FIX polypeptides provided herein also can exhibit other activities and/or properties. For example, some of the modified FIX polypeptides contain one or more modifications that increase catalytic activity. In other examples, the modified FIX polypeptides contain one or more modifications that decrease phosphorylation, sulfation, hydroxylation and/or glycosylation. In further examples, the modified FIX polypeptides contain modifications that interfere with the interaction between FIX and LRP. By interrupting the binding of FIX to LRP, the clearance of FIX from circulation can be decreased. Hence, modifications that reduce the binding of FIX to LRP can improve the pharmacokinetic properties of FIX in vivo.

The modifications, such as amino acid replacements, described herein, such as those modifications that introduce one or more non-native glycosylation sites or increase resistance to inhibitors, can be made in any FIX polypeptide (e.g. unmodified or wildtype FIX polypeptide), including a precursor FIX polypeptide with a sequence set forth in SEQ ID NO:2, a mature FIX polypeptide set forth in SEQ ID NO:3, or in a FIX polypeptide having a sequence of amino acids that exhibits at least 40%, 50%, 60%, 70%, 80%, 90%, 91%, 92%, 93%, 94%, 95%, 96%, 97%, 98%, or 99% sequence identity to the FIX polypeptide set forth in SEQ ID NOS:2 or SEQ ID NO:3. It is understood that reference herein to amino acid residues is with respect to the numbering of the mature FIX polypeptide set forth in SEQ ID NO:3. It is within the level of one of skill in the art to identify a corresponding amino acid residue in another FIX polypeptide of any form, such as a precursor, mature or other active form, by alignment of the sequence of the other FIX polypeptide with SEQ ID NO:3 (see e.g. FIGS. 3A-3D). Any amino acid replacement provided herein can be made at a corresponding amino acid residue that differs or is not the same as the replacement amino acid residue. It is within the level of one of skill in the art to test any resulting modified FIX polypeptide for activity or property as described herein.

For example, the modifications, such as an amino acid replacement, can be made in any species, allelic or modified variant, such as those described in the art. Allelic variants of FIX include, but are not limited to, T148A and T412P. Any of the amino acid replacements provided herein can be an Factor IX that contains mutations T148A or T412P. For example, the modifications such as any amino acid replacement, can be made in a FIX polypeptide set forth in SEQ ID NO:325 or SEQ ID NO:20. Exemplary species variants for modification herein include, but are not limited to, human and non-human polypeptides including FIX polypeptides from chimpanzee, rhesus macaque, mouse, rat, guinea pig, pig, dog, cat, rabbit, chicken, cow, sheep, frog, zebrafish and Japanese pufferfish FIX polypeptides, whose sequences are set forth in SEQ ID NOS:4-18, respectively. Modifications in a FIX polypeptide can be made to a FIX polypeptide that also contains other modifications, such as those described in the art, including modifications of the primary sequence and modifications not in the primary sequence of the polypeptide (see e.g. Section D.6, which describes exemplary modified FIX polypeptides to which the amino modifications described herein can be made).

In other examples, the modifications, such as an amino acid replacement, can be made in any active fragment of a FIX polypeptide, such as an active fragment of SEQ ID NO:2 or SEQ ID NO:3, or an active fragment of a species, allelic or modified variant, such as those described in the art, The active fragment contains a contiguous sequence of amino acids containing the catalytically active domain of the polypeptide or a catalytically active portion thereof containing the amino acid modifications, such as amino acid replacements describes herein. The active fragment exhibit at least 30%, 40%, 50%, 60%, 70%, 80%, 90%, 95% or more of the activity of the mature form of the polypeptide, such as the FIX polypeptide set forth in SEQ ID NO:3.

Modification of FIX polypeptides also include modification of polypeptides that are hybrids of different FIX polypeptides and also synthetic FIX polypeptides prepared recombinantly or synthesized or constructed by other methods known in the art based upon the sequence of known polypeptides. For example, based on alignment of FIX with other coagulation factor family members, including, but not limited to, factor FVII (FVII) and factor X (FX), homologous domains among the family members are readily identified. Chimeric variants of FIX polypeptides can be constructed where one or more amino acids or entire domains are replaced in the FIX amino acid sequence using the amino acid sequence of the corresponding family member. Additionally, chimeric FIX polypeptides include those where one or more amino acids or entire domains are replaced in the human FIX amino acid sequence using the amino acid sequence of a different species. Such chimeric proteins can be used as the starting, unmodified FIX polypeptide herein.

Modifications provided herein of a starting, unmodified reference polypeptide include amino acid replacements or substitution, additions or deletions of amino acids, or any combination thereof. For example, modified FIX polypeptides include those with 1, 2, 3, 4, 5, 6, 7, 8, 9, 10, 11, 12, 13, 14, 15, 16, 17, 18, 19, 20, 30, 40, 50 or more modified positions. In some examples, a modification that is made to alter one activity or property of FIX also can, or instead, affect one more other activities or properties. For example, a modification made to increase resistance to inhibitors also, or instead, can increase catalytic activity. In another example, a modification made to introduce a new glycosylation site also can result in increased resistance to inhibitors and/or increased catalytic activity. In a further example, a modification made to decrease binding to LRP can also, or instead, increase resistance to an inhibitor, such as AT-III/heparin. Thus, although the modifications described herein typically are described in relation to their intended affect on FIX activities or properties, it is understood that any of the modifications described herein, alone or in conjunction with one or more other modifications, can result in changes in other, unpredicted, activities or properties.

Any modification provided herein can be combined with any other modification known to one of skill in the art. Typically, the resulting modified FIX polypeptide exhibits increased coagulation activity when it is in its two-chain form. The activities or properties that can be altered as a result of modification include, but are not limited to, coagulation or coagulant activity; pro-coagulant activity; proteolytic or catalytic activity such as to effect factor X (FX) activation; antigenicity (ability to bind to or compete with a polypeptide for binding to an anti-FIX antibody); ability to bind FVIIIa, antithrombin HI, heparin and/or factor X; ability to bind to phospholipids; three-dimensional structure; pI; and/or conformation. Included among the modified FIX polypeptides provided herein are those that have increased resistance to antithrombin III (AT-III), increased resistance to heparin, altered glycosylation, such as increased glycosylation, increased catalytic activity, and improved pharmacokinetic properties, such as i) decreased clearance, ii) altered volume of distribution, iii) enhanced in vivo recovery, iv) enhanced total protein exposure in vivo (i.e., AUC), v) increased serum half-life ($\alpha$-, $\beta$-, and/or $\gamma$-phase), and/or vi) increased mean resonance time (MRT).

In some examples, a modification can affect two or more properties or activities of a FIX polypeptide. For example, a modification can result in increased AT-III resistance and increased catalytic activity of the modified FIX polypeptide compared to an unmodified FIX polypeptide. In another example, a modification that introduces a non-native N-glycosylation site and, thus, can increase the glycosylation levels of the polypeptide when expressed in an appropriate cell, such as a mammalian cell, also can result in increased catalytic activity of the modified FIX polypeptide compared to an unmodified FIX polypeptide. Modified FIX polypeptides provided herein can be assayed for each property and activity to identify the range of effects of a modification. Such assays are known in the art and described below. Typically, changes to the properties and/or activities of the modified FIX polypeptides provided herein are made while retaining other FIX activities or properties, such as, but not limited to, binding to FVIIIa and/or binding and activation of FX. Hence, modified FIX polypeptides provided herein retain FVIIIa binding and/or FX binding and activation as compared to a wild-type or starting form of the FIX polypeptide. Typically, such activity is substantially unchanged (less than 1%, 5% or 10% changed) compared to a wild-type or starting protein. In other examples, the activity of a modified FIX polypeptide is increased or is decreased as compared to a wild-type or starting FIX polypeptide. Activity can be assessed in vitro or in vivo and can be compared to the unmodified FIX polypeptide, such as for example, the mature, wild-type native FIX polypeptide (SEQ ID NO:3), the wild-type precursor FIX polypeptide (SEQ ID NO:2), or any other FIX polypeptide known to one of skill in the art that is used as the starting material.

The modifications provided herein can be made by standard recombinant DNA techniques such as are routine to one of skill in the art. Any method known in the art to effect mutation of any one or more amino acids in a target protein can be employed. Methods include standard site-directed mutagenesis of encoding nucleic acid molecules, or by solid phase polypeptide synthesis methods.

Other modifications that are or are not in the primary sequence of the polypeptide also can be included in a modified FIX polypeptide, or conjugate thereof, including, but not limited to, the addition of a carbohydrate moiety, the addition of a polyethylene glycol (PEG) moiety, the addition of an Fc domain, a serum albumin and/or other protein. For example, such additional modifications can be made to increase the stability or half-life of the protein.

The resulting modified FIX polypeptides include those that are single-chain zymogen polypeptides and those that are two-chain zymogen-like polypeptides (i.e. FIXa polypeptides that are not bound to the cofactor, FVIIIa). Any modified FIX polypeptide provided herein that is a single-chain polypeptide can be activated to generate a modified FIXa (i.e. a two-chain form). The activities of a modified FIX polypeptide are typically exhibited in its two-chain form.

1. Exemplary Amino Acid Replacements

Provided herein are modified FIX polypeptides that contain one or more amino acid replacements as described herein below with numbering of residues with respect to the numbering of SEQ ID NO:3. The same amino acid replacements can be made in corresponding amino acid residues in another FIX polypeptide (see e.g. FIGS. 3A-3D for exemplification of identification of corresponding amino acid residues). The amino acid replacements confer altered glycosylation (e.g. by introduction of non-native glycosylation sites or elimination of native glycosylation sites), increased resistance to AT-III and/or heparin, increased catalytic activity, decreased LRP binding and/or alter posttranslational modifications. The resulting modified FIX polypeptides exhibit improved therapeutic efficacy, for example, due to improved pharmacodynamic or pharmacokinetic activity.

In particular, non-limiting examples of amino acid replacements in modified FIX polypeptides provided herein below are at any one or more amino acid residues 155, 318, 338, 343, 403 and/or 410 with numbering with respect to the mature FIX polypeptide set forth in SEQ ID NO:3 (corresponding to amino acid residues [155], 150, 170, 175, 233 and/or 240, respectively, by chymotrypsin numbering). The residues corresponding to any of 155, 318, 338, 343, 403 and/or 410 in other FIX polypeptides can be determined by sequence alignment with SEQ ID NO:3 (see e.g. FIGS. 3A-3D). It is understood that the amino acid replacements provided herein at any of amino acid residues 155, 318, 338, 343, 403 and/or 410 with numbering with respect to SEQ ID NO:3 can be made in other FIX polypeptides as described elsewhere herein. It is also understood that residues corresponding to any of the other amino acid replacements provided herein also can be identified in other FIX polypeptides as exemplified herein (e.g. FIGS. 3A-3D).

In particular, provided herein are amino acid replacement of tyrosine at amino acid residue Y155 (Y155F), Y155L, Y155H, R318A, R318Y, R318E, R318F, R318W, R318D, R318I, R318K, R318L, R318M, R318N, R318S, R318V, R318Y, R338A, R338E, T343R, T343E, T343D, T343F, T343I, T343K, T343L, T343M, T343Q, T343S, T343V, T343W, T343Y, R403A, R403E, E410Q, E410S, E410N, E410A, E410D, or a conservative amino acid replacement (see e.g. Table 2B). In some examples, the amino acid replacement is Y155F, R318Y, R318E, R338E, T343R, R403E and/or E410N or conservative amino acid replacements thereof.

For example, as shown by the data herein, amino acid replacement at position R318 with reference to SEQ ID NO:3 (150 by chymotrypsin numbering) confers resistance to inhibition by the AT-III/heparin complex. An amino acid replacement at position R338 (R170 by chymotrypsin numbering) also confers resistance to inhibition by the AT-III/heparin complex. In this respect, the amino acid position R338 is the site of a natural mutation (R170L) that has been reported to exhibit 5-10 fold enhanced clotting activity in an in vitro clotting assay (International Pat. Pub. No. WO 2010029178). The assay as described was performed with conditioned media rather than purified protein and the protein concentration was measured using an ELISA assay. Consequently, these data could reflect a higher fraction of active material in the R338L (R170L) preparation as compared to the wildtype comparator preparation or a higher level of contaminants that are active in a clotting assay. Nevertheless, as shown herein, there is a 3.5- to 4-fold increased efficiency for FX activation by variants containing A, E and L at position 338 (170). As found herein, the R338E mutation, in addition, exhibited an approximately 88-fold resistance to inhibition by the heparin/AT-III complex as well as 2-fold enhanced binding to the co-factor, FVIIIa.

A 4 amino acid thrombin loop swap mutation into FIX, from positions 342-345 (174-177 by chymotrypsin numbering) has been reported to reduce the binding of FIXa to sLRP (see, Rohlena et al., (2003) *J. Biol. Chem.* 9394-9401). Mutation of the residue at position T343 (T175 by chymotrypsin numbering) did not confer any significant affect on the pharmacokinetic (PK) properties of FIX. It is found herein that the mutation T343R (T175R by chymotrypsin numbering), however, increases the catalytic efficacy for activation of FX by a factor of about 3.1, produces an approximately 5.6-fold resistance to the heparin/AT-III complex, and increases the affinity for FVIIIa by a factor of approximately 1.6-fold.

Also as shown herein, mutations at position R403 (R233 by chymotrypsin numbering) confer resistance to inhibition by the heparin/AT-III complex. Mutations at position E410 (E240 by chymotrypsin numbering), such as E410N, produce a significant, heretofore unobserved, 1.3- to 2.8-fold increase in the catalytic efficacy for activation of FX.

Also, as shown therein, there is a synergy in mutations at R338 and T343 (R170 and T175 by chymotrypsin numbering), particularly R338E and T343R in enhanced binding to the co-factor FVIII. Synergy also was observed between mutations at positions R338 and E410 (R170 and E240 by chymotrypsin numbering), particularly R338E and E410N. The two double mutants, exemplified herein, R338E/T343R and R338E/E410N exhibit 24- to 28-fold improved binding to FVIIIa while each of the single mutations alone enhance binding by 1.6-2.2-fold each.

Other exemplary amino acid replacements in a FIX polypeptide provided herein found to confer an altered property or activity as described below can be at any amino acid residue from among 1, 5, 53, 61, 64, 85, 103, 104, 105, 106, 108, 148, 157, 158, 159, 167, 169, 172, 179, 202, 203, 204, 205, 228, 239, 241, 243, 247, 249, 251, 257, 259, 260, 262, 284, 293, 312, 314, 315, 316, 317, 319, 320, 321, 333, 342, 345, 346, 392, 394, 400, 412, or 413 with reference to SEQ ID NO:3 or at a corresponding amino acid residue. For example, exemplary amino acid replacements in a FIX polypeptide provided herein also include, but are not limited to, Y1N, K5A, S53A, S61A, S61C, S61D, S61E, S61F, S61G, S61I, S61K, S61L, S61P, S61R, S61V, S61W, S61Y, D64A, D64C, D64F, D64H, D64I, D64L, D64M, D64N, D64P, D64R, D64S, D64T, D64W, D85N, A103N, D104N, N105S, N105T, K106N, K106S, K106T, V108S, V108T, T148A, N157D, N157E, N157F, N157I, N157K, N157L, N157M, N157Q, N157R, N157V, N157W, N157Y, S158A, S158D, S158E, S158F, S158G, S158I, S158K, S158L, S158M, S158R, S158V, S158W, S158Y, T159A, N167D, N167Q, N167E, N167F, N167G, N167H, N167I, N167K, N167L, N167M, N167P, N167R, N167V, N167W, N167Y, T169A, T169D, T169E, T169F, T169G, T169I, T169K, T169L, T169M, T169P, T169R, T169S, T169V, T169W, T169Y, T172A, T172D, T172E, T172F, T172G, T172I, T172K, T172L, T172M, T172P, T172R, T172S, T172V, T172W, T172Y, T179A, V202M, V202Y, D203N, D203M, D203Y, D203F, D203H, D203I, D203K, D203L, D203R, D203V, D203W, A204M, A204Y, A204F, A204I, A204W, F205S, F205T, K228N, E239A, E239S, E239R, E239K, E239D, E239F, E239I, E239L, E239M, E239N, E239T, E239V, E239W, E239Y, T241N, H243S, H243T, K247N, N249S, N249T, I251S, H257F, H257E, H257D, H257I, H257K, H257L, H257M, H257Q, H257R, H257S, H257V, H257W, H257Y, N260S, A262S, A262T, Y284N, K293E, K293A, R312A, R312Y, R312L, R312C, R312D, R312E, R312F, R312I, R312K, R312L, R312M, R312P, R312Q, R312S, R312T, R312V, R312W, R312Y, F314N, H315S, K316M, K316D, K316F, K316H, K316I, K316L, K316M, K316R, K316S, K316T, K316V, K316W, K316Y, G317N, S319N, A320S, L321N, L321S, L321T, R333A, R333E, F342I, F342D, F342E, F342K, F342L, F342M, F342S, F342T, F342V, F342W, F342Y, Y345A, Y345T, N346D, N346Y, N346E, N346F, N346H, N346I, N346K, N346L, N346M, N346Q, N346R, N346T, N346V, N346W, K392N, K394S, K394T, K400A, K400E, K400C, K400D, K400F, K400G, K400L, K400M, K400P, K400S, K400T, K400V, K400Y, T412A, T412V, T412C, T412D, T412E, T412F, T412G, T412I, T412M, T412P, T412W, T412Y, K413N in a mature FIX polypeptide having a sequence set forth in SEQ ID NO:3 or the same replacement in a corresponding amino acid residue position.

For example, exemplary properties and actives that are altered by the modifications (e.g. amino acid replacements) provided herein are described as follows.

a. Altered Glycosylation

The modified factor IX polypeptides provided herein can exhibit altered glycosylation levels and/or altered types of glycosylation compared to an unmodified FIX polypeptide. In some examples, the modified FIX polypeptides provided herein exhibit increased glycosylation compared to an unmodified FIX polypeptide. Thus, among the modified FIX polypeptides described herein are hyperglycosylated FIX polypeptides.

i. Advantages of Glycosylation

Many mammalian proteins are glycosylated with variable numbers of carbohydrate chains, each of which can have differing carbohydrate structures. Such carbohydrates can have an important role in the stability, solubility, activity, serum half-life and immunogenicity of the protein. Thus, the properties and activities of a protein can be altered by modulating the amount and/or type of glycosylation. For example, glycosylation can increase serum-half-life of polypeptides by increasing the stability, solubility, and reducing the immunogenicity of a protein. This is of particular interest for therapeutic polypeptides, where increased solubility, serum half-life and stability of the therapeutic polypeptide can result in increased therapeutic efficacy.

Oligosaccharides are important in intra- and inter-cell events such as a recognition, signaling and adhesion. Carbohydrates also assist in the folding of secreted proteins. Glycosylation sites provide a site for attachment of monosaccharides and oligosaccharides to a polypeptide via a glycosidic linkage, such that when the polypeptide is produced, for example, in a eukaryotic cell capable of glycosylation, it is glycosylated. There are several types of protein glycosylation. N-linked and O-linked glycosylation are the major classes, in which an asparagine residue, or a serine or threonine residue, respectively, is modified. Other types of glycans include, glycosaminoglycans and glycosylphophatidylinositol (GPI)-anchors. Glycosaminoglycans are attached to the hydroxy oxygen of serine, while GPI anchors attach a protein to a hydrophobic lipid anchor, via a glycan chain. C-glycosylation also can occur at the consensus sequence Trp-X-X-Trp, where the indol side chain of the first tryptophan residue in the sequences is modified with an α-mannopyranosyl group (Furmanek et al., (2000) Acta Biochim. Pol. 47:781-789).

The presence of a potential glycosylation site does not, however, ensure that the site will be glycosylated during post-translational processing in the ER. Furthermore, the level of glycosylation can vary at any given site, as can the glycan structures. The differences in levels and types of glycosylation at particular sites can be attributed, at least in part, to the sequence context and secondary structure around the potential glycosylation site.

O-linked glycosylation involves the attachment of the sugar units, such as N-acetylgalactosamine, via the hydroxyl group of serine, threonine, hydroxylysine or hydroxyproline residues. It is initiated by the attachment of one monosaccharide, following which others are added to form a mature O-glycan structure. There is no known motif for O-glycosylation, although O-glycosylation is more probable in sequences with a high proportion of serine, threonine and proline residues. Further, secondary structural elements such as an extended β turn also may promote O-glycosylation. O-glycosylation lacks a common core structure. Instead, several types of glycans can be attached at the selected O-glycosylation sites, including O-N-acetylgalactosamine (O-GalNAc), O-N-acetylglucosamine (O-GlcNAc), O-fucose and O-glucose.

In contrast to O-glycosylation, the N-linked glycosylation consensus sequence motif is well characterized. During N-linked glycosylation, a 14-residue oligosaccharide is transferred to the asparagine residue in the Asn-X-Ser/Thr/Cys consensus motif, where X is any amino acid except Pro. Glycosyltransferases then enzymatically trim the saccharide and attach additional sugar units to the mannose residues. The sequence adjacent to the consensus motif also can affect whether or not glycosylation occurs at the consensus sequence. Thus, the presence of the Asn-X-Ser/Thr/Cys consensus sequence is required but not necessarily sufficient for N-linked glycosylation to occur. In some instances, changes to the adjacent sequence results in glycosylation at the consensus motif where there previously was none (Elliot et al., (2004) J. Biol. Chem. 279:16854-16862).

N-linked oligosaccharides share a common core structure of $GlcNAc_2Man_3$. There are three major types of N-linked saccharides in mammals: high-mannose oligosaccharides, complex oligosaccharides and hybrid oligosaccharides. High-mannose oligosaccharides essentially contain two N-acetylglucosamines with several mannose residues. In some instances, the final N-linked high-mannose oligosaccharide contains as many mannose residues as the precursor oligosaccharide before it is attached to the protein. Complex oligosaccharides can contain almost any number of mannose, N-acetylglucosamines and fucose saccharides, including more than the two N-acetylglucosamines in the core structure.

Glycosylation can increase the stability of proteins by reducing the proteolysis of the protein and can protect the protein from thermal degradation, exposure to denaturing agents, damage by oxygen free radicals, and changes in pH. Glycosylation also can allow the target protein to evade clearance mechanisms that can involve binding to other proteins, including cell surface receptors. The sialic acid component of carbohydrate in particular can enhance the serum half-life of proteins. Sialic acid moieties are highly hydrophilic and can shield hydrophobic residues of the target protein. This increases solubility and decreases aggregation and precipitation of the protein. Decreased aggregation reduces the likelihood of an immune response being raised to the protein. Further, carbohydrates can shield immunogenic sequences from the immune system, and the volume of space occupied by the carbohydrate moieties can decrease the available surface area that is surveyed by the immune system. These properties can lead to the reduction in immunogenicity of the target protein.

Modifying the level and/or type of glycosylation of a therapeutic polypeptide can affect the in vivo activity of the polypeptide. By increasing the level of glycosylation, recombinant polypeptides can be made more stable with increased serum half-life, reduced serum clearance and reduced immunogenicity. This can increase the in vivo activity of the polypeptide, resulting in reduced doses and/or frequency of dosing to achieve a comparable therapeutic effect. For example, a hyperglycosylated form of recombinant human erythropoietin (rHuEPO), called Darbepoetin alfa (DA), has increased in vivo activity and prolonged duration of action. The increased carbohydrate and sialic acid content of the hyperglycosylated DA polypeptide results in a serum half-life that is three times greater than that of the unmodified rHuEPO. This increased serum half-life results in increased bioavailability and reduced clearance, which can allow for less frequent dosing and/or lower dosages, with associated increased convenience for the patient, reduced risk of adverse effects and improved patient compliance.

ii. Exemplary Modified FIX Polypeptides with Altered Glycosylation

Provided herein are modified FIX polypeptides that are modified to exhibit altered glycosylation compared to an unmodified FIX polypeptide. The modified FIX polypeptides can exhibit increased or decreased glycosylation, such as by the incorporation of non-native glycosylation sites or the deletion of native glycosylation sites, respectively. For example, the modified FIX polypeptides can contain 1, 2, 3, 4 or more non-native N-glycosylation sites. The non-native N-glycosylation sites can be introduced by amino acid replacement(s) (or substitution(s)), insertion(s) or deletion(s), or any combination thereof, wherein the amino acid replacement(s), insertion(s) and/or deletion(s) result in the establishment of the glycosylation motif Asn-Xaa-Ser/Thr/Cys, where Xaa is not proline. In other examples, the modified FIX polypeptides provided herein can have a reduced number of glycosylation sites compared to an unmodified FIX polypeptide, typically resulting in a reduced level of glycosylation compared to the unmodified FIX polypeptide. In further examples, the modified FIX polypeptides exhibit the same levels of glycosylation as wild-type FIX, but exhibit different types of glycosylation. For example, a modified FIX polypeptide can exhibit the same number of glycosylation sites and the same level of glycosylation as an unmodified FIX polypeptide, but can have different types of glycosylation, such as, for example, different relative amounts of N- and O-glycosylation compared to an unmodified FIX polypeptide.

(a). Introduction of Non-Native Glycosylation Site(s)

In particular examples, a non-native N-glycosylation site is introduced by amino acid replacement. In some instances, the creation of a non-native N-glycosylation site by amino acid replacement requires only one amino acid replacement. For example, if the unmodified FIX polypeptide contains a Gly-Ala-Ser sequence, then an N-glycosylation site can be created by a single amino acid substitution of the glycine with an asparagine, to create a Asn-Ala-Ser N-glycosylation motif. In another example, if the unmodified FIX polypeptide contains a Asn-Trp-Met sequence, then an N-glycosylation site can be created by a single amino acid substitution of the methionine with a cysteine (or threonine or serine). In other instances, the creation of a non-native N-glycosylation site by amino acid replacement requires more than one amino acid replacement. For example, if the unmodified FIX polypeptide contains a Gly-Arg-Phe sequence, then an N-glycosylation site can be created by two amino acid replacements: an amino acid substitution of the glycine with an asparagine, and an amino acid substitution of the phenylalanine with a cysteine (or threonine or serine), to create a Asn-Arg-Ser/Thr/Cys N-glycosylation motif. Thus, one of skill in the art can introduce one or more non-native N-glycosylation sites at any position in the FIX polypeptide.

The position at which a non-native glycosylation site is introduced into the FIX polypeptide to generate the modified FIX polypeptides provided herein is typically selected so that any carbohydrate moieties linked at that site do not adversely interfere with the structure, function and/or procoagulant activity of the FIX polypeptide, or that the amino acid modification(s) made to the polypeptide to introduce the non-native glycosylation site do not adversely interfere with the structure, function or activity of the FIX polypeptide. Thus, a non-native glycosylation site can be introduced into any position in a FIX polypeptide provided the resulting modified FIX polypeptide retains at least one activity of the wild type or unmodified FIX polypeptide. Conversely, one or more non-native glycosylation sites can be introduced into the modified FIX polypeptide at sites that may be involved in the interaction of FIX with an inhibitory molecule. The carbohydrate moiety that is linked to the new glycosylation site can sterically hinder the interaction between the inhibitory molecule and the modified FIX. Such steric hindrance can result in a modified FIX polypeptide with increased coagulant activity. For example, a carbohydrate moiety that is linked to a non-native glycosylation site contained in the modified FIX polypeptides provided herein can sterically hinder the interaction of the modified FIX with the AT-III/heparin complex. This can result in increased resistance of the modified FIX polypeptide to the inhibitory effects of AT-III/heparin.

Thus, a non-native glycosylation site can be introduced into the Gla domain, EGF1 domain, EGF2 domain, activation peptide and/or the protease domain, provided the resulting modified FIX polypeptide retains at least one activity of the wild type or unmodified FIX polypeptide. In other examples, a non-native glycosylation site is introduced into the EGF2 domain or the protease domain. The resulting modified FIX polypeptide retains at least one activity of the unmodified FIX polypeptide. In some examples, the modified FIX polypeptide retains at least 5%, 10%, 20%, 30%, 40%, 50%, 60%, 70%, 80%, 90%, 95% or more of the catalytic activity of the unmodified FIX polypeptide. In other examples, the modified FIX polypeptide retains at least 5%, 10%, 20%, 30%, 40%, 50%, 60%, 70%, 80%, 90%, 95% or more of the binding activity for FX of the unmodified FIX polypeptide. In other examples, the modified FIX polypeptide retains at least 5%, 10%, 20%, 30%, 40%, 50%, 60%, 70%, 80%, 90%, 95% or more of the binding activity for FVIIIa of the unmodified FIX polypeptide. In some assays and/or under some conditions, the modified FIX polypeptides can exhibit increased activity compared with the unmodified FIX protein (e.g., pharmacodynamic activity in vivo, and/or catalytic activity in the presence of ATIII/heparin or plasma)

Table 3 provides non-limiting examples of exemplary amino acid replacements, corresponding to amino acid positions of a mature FIX polypeptide as set forth in SEQ ID NO:3, that are included in a modified FIX polypeptide to increase glycosylation levels by introducing a non-native N-glycosylation site. In reference to such' mutations, the first amino acid (one-letter abbreviation) corresponds to the amino acid that is replaced, the number corresponds to the position in the mature FIX polypeptide sequence with reference to SEQ ID NO:3, and the second amino acid (one-letter abbreviation) corresponds to the amino acid selected that replaces the first amino acid at that position. The amino acid positions for mutation also are referred to by the chymotrypsin numbering scheme where appropriate (i.e., when the mutation is located within the FIX protease domain). In instances where a modified amino acid position does not have a corresponding chymotrypsin number (i.e. is not within amino acid positions 181 to 415 corresponding to a mature FIX polypeptide set forth in SEQ ID NO:3, and is not set forth in Table 1, above), the position is denoted in brackets using mature FIX numbering. For example, A103N does not have a corresponding chymotrypsin number and is set forth as A[103]N when referring to chymotrypsin numbering. In Table 3 below, the sequence identifier (SEQ ID NO) is identified in which exemplary amino acid sequences of the modified FIX polypeptide are set forth. Also identified in Table 3 are the positions of the non-native glycosylation sites generated by the modifications.

In some instances, only one amino acid replacement is required to create a non-native N-glycosylation site. For example, the aspartic acid (Asp, D) at position 85 (corresponding to the mature FIX polypeptide set forth in SEQ ID NO:3) can be replaced with an asparagine (Asn, N) to generate a non-native glycosylation site in the EGF2 domain at amino acid position 85 in the resulting modified FIX polypeptide. In another example, the isoleucine (Ile, I) at position 251 (corresponding to the mature FIX polypeptide set forth in SEQ ID NO:3) can be replaced with a serine (Ser, S) to generate a non-native N-glycosylation site in the protease domain at amino acid position 249 in the resulting modified FIX polypeptide. In other instances, two amino acid replacements are required to create a new glycosylation site. For example, the alanine (Ala, A) at position 103 (based on numbering of a mature FIX set forth in SEQ ID NO:3) can be replaced with an asparagine (Asn, N), and the asparagine at position 105 can be replaced with a serine (Ser; S) to create a non-native N-glycosylation site in the EGF2 domain at amino acid position 103 in the resulting modified FIX polypeptide. In another example, the threonine (Thr, T) at position 241 is replaced with an asparagine and the histidine (His, H) at position 243 is replaced with a serine to create a non-native N-glycosylation site in the protease domain at amino acid position 243.

TABLE 3

| Modification (mature FIX numbering) | Modification (chymotrypsin numbering) | Non-native glycosylation site (mature FIX numbering) | Non-native glycosylation site (chymotrypsin numbering) | SEQ ID NO |
|---|---|---|---|---|
| A103N/N105S | A[103]N/N[105]S | N103 | N[103] | 77 |
| D104N/K106S | D[104]N/K[106]S | N104 | N[104] | 78 |
| K106N/V108S | K[106]N/V[108]S | N106 | N[106] | 79 |
| D85N | D[85]N | N85 | N[85] | 80 |
| D203N/F205T | D39N/F41T | N203 | N39 | 99 |
| K228N | K63N | N228 | N63 | 101 |
| I251S | I86S | N249 | N84 | 103 |
| A262S | A95bS | N260 | N95 | 106 |
| K413N | K243N | N413 | N243 | 107 |
| E410N | E240N | N410 | N240 | 108 |
| E239N | E74N | N239 | N74 | 109 |
| T241N/H243S | T76N/H78S | N241 | N76 | 110 |
| K247N/N249S | K82N/N84S | N247 | N82 | 111 |
| L321N | L153N | N321 | N153 | 112 |
| K392N/K394S | K222N/K224S | N392 | N222 | 114 |
| N260S | N95S | N258 | N93 | 116 |
| S319N/L321S | S151N/L153S | N319 | N151 | 115 |
| Y284N | Y117N | N284 | N117 | 117 |
| G317N | G149N | N317 | N149 | 118 |
| R318N/A320S | R150N/A152S | N318 | N150 | 119 |
| F314N/K316S | F145N/K148S | N314 | N145 | 177 |

The modified FIX polypeptides provided herein can contain modifications that result in the introduction of two or more non-native N-glycosylation sites. For example, the modifications set forth in Table 3 can be combined, resulting in a modified FIX polypeptide that contains 2, 3, 4, 5, 6 or more non-native N-glycosylation sites. Any two or more of the modifications set forth in Table 3 can be combined. For example, included among the modified FIX polypeptides provided herein are modified FIX polypeptides that contain the amino acid substitutions D104N/K106S/K228N, resulting in a FIX polypeptide with two non-native glycosylation sites at amino acid positions 104 and 228, respectively (numbering corresponding to the mature FIX polypeptide set forth in SEQ ID NO:3). In another example, a modified FIX polypeptide can contain amino acid substitutions D85N/K247N/N249S/K392N/K394S, resulting in a FIX polypeptide with three non-native glycosylation sites at amino acid positions 85, 247 and 392, respectively (numbering corresponding to the mature FIX polypeptide set forth in SEQ ID NO:3). Table 4 sets forth exemplary FIX polypeptides having two or more non-native N-glycosylation sites.

TABLE 4

| Modifications (mature FIX numbering) | Modifications (chymotrypsin numbering) | Non-native glycosylation site (mature FIX numbering) | Non-native glycosylation site (chymotrypsin numbering) | SEQ ID NO. |
|---|---|---|---|---|
| D85N/I251S | D[85]N/I86S | N85 and N149 | N[85] and N84 | 104 |
| D85N/D203N/F205T | D[85]N/D39N/F41T | N85 and N203 | N[85] and N39 | 100 |
| D85N/K228N | D[85]N/K63N | N85 and N228 | N[85] and N63 | 102 |
| D85N/D104N/K106S/I251S | D[85]N/D[104N]/K[106]6/I86S | N85, N104 and N249 | N[85], N[104] and N84 | 105 |
| A103N/N105S/K247N/N249S | A[103]N/N[105]S/K82N/N84S | N103 and N247 | N[103] and N82 | 178 |
| D104N/K106S/K247N/N249S | D[104]N/K[106]S/K82N/N84S | N104 and N247 | N[104] and N82 | 179 |
| K228N/I251S | K63N/I86S | N228 and N249 | N63 and N84 | 180 |
| A103N/N105S/I251S | A[103]N/N[105]S/I86S | N103 and N249 | N[103] and N84 | 181 |
| D104N/K106S/I251S | D[104]N/K[106]S/I86S | N104 and N249 | N[104] and N84 | 182 |
| K228N/K247N/N249S | K63N/K82N/N84S | N228 and N247 | N63 and N82 | 183 |
| K228N/K247N/N249S/D104N/K106S | K63N/K82N/N84S/D[104]N/K[106]S | N228, N247 and N104, | N63, N82 and N[104] | 184 |
| D104N/K106S/N260S | D[104]N/K[106]S/N95S | N104 and N258 | N[104] and N93 | 185 |

The modified FIX polypeptides provided herein can contain one or more non-native glycosylation sites, such as one or more non-native N-glycosylation sites. Thus, when expressed in a cell that facilitates glycosylation, or when glycosylated using in vitro techniques well know in the art, the modified FIX polypeptides can exhibit increased levels of glycosylation compared to an unmodified FIX polypeptide. The level of glycosylation can be increased by at least or at least about 1%, 2%, 3%, 4%, 5%, 6%, 7%, 8%, 9%, 10%, 20%, 30%, 40%, 50%, 60%, 70%, 80%, 90%, 100%, 200%, 300%, 400%, 500%, or more compared to the level of glycosylation of unmodified or wild-type FIX polypeptide.

The modifications described herein to introduce one or more non-native glycosylation sites can be combined with any other mutation described herein or known in the art. Typically, the resulting modified FIX polypeptide exhibits increased coagulant activity compared to an unmodified FIX polypeptide. For example, one or more modifications that introduce one or more non-native glycosylation sites can be combined with modification(s) that increase resistance to an inhibitor, such as AT-III and/or heparin, increase catalytic activity, increase intrinsic activity, increase binding to phospholipids, decrease binding to LRP and/or improve pharmacokinetic and/or pharmacodynamic properties.

The modified FIX polypeptides provided herein that contain one or more non-native glycosylation sites and have altered glycosylation, such as increased levels of glycosylation, retain at least one activity of FIX, such as, for example, catalytic activity for its substrate, FX. Typically, the modified FIX polypeptides provided herein retain at least or at least about 5%, 10%, 20%, 30%, 40%, 50%, 60%, 70%, 80%, 90%, 95% or more of the catalytic activity exhibited by an unmodified FIX polypeptide. Increased levels of glycosylation can improve the pharmacokinetic properties of the modified FIX polypeptides by endowing the variant with one or more of the following properties: i) decreased clearance, ii) altered volume of distribution, iii) enhanced in vivo recovery, iv) enhanced total protein exposure in vivo (i.e., AUC), v) increased serum half-life (α, β, and/or γ phase), and/or vi) increased mean resonance time (MRT) compared to an unmodified FIX. The coagulant activity of the modified FIX polypeptides with altered glycosylation can be increased by at least or at least about 1%, 2%, 3%, 4%, 5%, 6%, 7%, 8%, 9%, 10%, 20%, 30%, 40%, 50%, 60%, 70%, 80%, 90%, 100%, 200%, 300%, 400%, 500%, or more compared to the coagulation activity of unmodified or wild-type FIX polypeptide either in vivo or in vitro.

(b). Elimination of Native Glycosylation Sites

The modified FIX polypeptides provided herein can have a reduced number of glycosylation sites compared to an unmodified FIX polypeptide. Typically, a reduction in the number of glycosylation sites results in a reduced level of glycosylation compared to the unmodified FIX polypeptide. The native glycosylation sites that can be removed include, for example, native N-glycosylation sites at amino acid positions corresponding to positions 157 and 167 of the mature FIX set forth in SEQ ID NO:3, and native O-glycosylation sites at amino acid positions corresponding to positions 53, 61, 159, 169, 172 and 179 of the mature FIX set forth in SEQ ID NO:3.

Any one or more native glycosylation sites can be removed by amino acid replacement(s), insertion(s) or deletion(s), or any combination thereof. For example, an amino acid replacement, deletion and/or insertion can be made to destroy the Asn/Xaa/Ser/Thr/Cys motif (where Xaa is not a proline), thereby removing an N-glycosylation site at position 157 or 167. In other examples, O-glycosylation sites are removed, such as by amino acid replacement or deletion of the serine residues at positions 53 or 61, or amino acid replacement or deletion of the threonine residues at positions 159 or 169. The resulting modified FIX polypeptide retains at least one activity of the unmodified FIX polypeptide. In some examples, the modified FIX polypeptide retains at least 5%, 10%, 20%, 30%, 40%, 50%, 60%, 70%, 80%, 90%, 95% or more of the catalytic activity of the unmodified FIX polypeptide. In other examples, the modified FIX polypeptide retains at least 5%, 10%, 20%, 30%, 40%, 50%, 60%, 70%, 80%, 90%, 95% or more of the binding activity for FX of the unmodified FIX polypeptide. In other examples, the modified FIX polypeptide retains at least 5%, 10%, 20%, 30%, 40%, 50%, 60%, 70%, 80%, 90%, 95% or more of the binding activity for FVIIIa of the unmodified FIX polypeptide. In some assays and/or under some conditions, the modified FIX polypeptides can exhibit enhanced properties compared with unmodified FIX (e.g., including but not limited to, increased in vivo recovery, increased AUC in vivo, and/or decreased clearance in vivo).

Table 5 provides non-limiting examples of exemplary amino acid replacements, corresponding to amino acid positions of a mature FIX polypeptide as set forth in SEQ ID NO:3, that are included in a modified FIX polypeptide to decrease glycosylation levels by removing or eliminating a native N-glycosylation site. In Table 5 below, the sequence identifier (SEQ ID NO) is identified in which exemplary amino acid sequences of the modified FIX polypeptide are set forth.

TABLE 5

| Mutation (Mature FIX Numbering) | Mutation (Chymotrypsin Numbering) | SEQ ID NO |
|---|---|---|
| S53A | S[53]A | 88 |
| S61A | S[61]A | 87 |
| N157D | N[157]D | 75 |
| N157Q | N[157]Q | 98 |
| T159A | T[159]A | 89 |
| N167D | N[167]D | 85 |
| N167Q | N[167]Q | 86 |
| T169A | T[169]A | 90 |
| T172A | T[172]A | 91 |
| T179A | T[179]A | 92 |

The modifications described herein to eliminate one or more native glycosylation sites can be combined with any other mutation described herein or known in the art. Typically, the resulting modified FIX polypeptide exhibits increased coagulant activity compared to an unmodified FIX polypeptide. For example, one or more modifications that eliminate one or more native glycosylation sites can be combined with modification(s) that introduce a non-native glycosylation site, increase resistance to an inhibitor, such as AT-III and/or heparin, increase catalytic activity, increase intrinsic activity, increase binding to phospholipids, or improve pharmacokinetic and/or pharmacodynamic properties.

The modified FIX polypeptides provided herein that eliminate one or more native glycosylation sites retain at least one activity of FIX, such as, for example, catalytic activity for its substrate, FX. Typically, the modified FIX polypeptides provided herein retain at least or at least about 5%, 10%, 20%, 30%, 40%, 50%, 60%, 70%, 80%, 90%, 95% or more of the catalytic activity exhibited by an unmodified FIX polypeptide. In some instances, the coagulant activity of the modified FIX polypeptides with altered glycosylation can be increased by at least or at least about 1%, 2%, 3%, 4%, 5%, 6%, 7%, 8%, 9%, 10%, 20%, 30%, 40%, 50%, 60%, 70%, 80%, 90%, 100%, 200%, 300%, 400%, 500%, or more compared to the coagulation activity of unmodified or wild-type FIX polypeptide either in vivo or in vitro.

b. Increased Resistance to AT-III and Heparin

The activity of FIX can be inhibited by factors in the blood as part of the regulation of the coagulation process. Thus, provided herein are modified FIX polypeptides that exhibit increased resistance to the inhibitory effects of inhibitors, including AT-III and heparin. In some examples, the modified FIX polypeptides provided herein exhibit reduced binding affinity for heparin and/or a decreased second order rate constant for inhibition by AT-III alone and/or the AT-III/heparin complex. In further examples, the modified FIX polypeptides exhibit increased resistance to the AT-III alone, or heparin alone. Thus, provided herein are modified FIX polypeptides that exhibit increased resistance to AT-III, the AT-III/heparin complex and/or heparin.

i. AT-III

Antithrombin III (also known as antithrombin or AT-III) is an important anticoagulant serpin (serine protease inhibitor). AT-III is synthesized as a precursor protein containing 464 amino acid residues (SEQ ID NO:21). In the course of secretion a 32 residue signal peptide is cleaved to generate a 432 amino acid mature human antithrombin (SEQ ID NO:22). The 58 kDa AT-III glycoprotein circulates in the blood and functions as a serine protease inhibitor (serpin) to inhibit a large number of serine proteases of the coagulation system. The principal targets of AT-III are thrombin, factor Xa and factor IXa, although AT-III also has been shown to inhibit the activities of FXIa, FXIIa and, to a lesser extent, FVIIa.

The action of AT-III is greatly enhanced by glycosaminoglycans, such as the naturally occurring heparan sulphate or the various tissue-derived heparins that are widely used as anticoagulants in clinical practice. Unlike other serpins, which typically are effective without binding a secondary molecule, the reaction of AT-III in the absence of heparin with is target coagulations factors is unusually slow. In the absence of heparin, the reactive loop sequence of AT-III provides the determinants of the slow reactivity. Mutagenesis of the conserved P2-P1' residues in the reactive loop center of AT-III, for example, affects the interaction of AT-III with proteases in the absence but not the presence of heparin.

AT-III binds in a highly specific manner to a unique pentasaccharide sequence in heparin that induces a conformational change in the reactive center loop. In such a conformation, the reactive center loop of AT-III can more efficiently interact with the reactive site of the serine protease, and effect inhibition. Evidence suggests that binding of heparin to AT-III generates new exosites that promote the interaction of FIXa, thrombin and FXa with AT-III. The tyrosine at position 253 and the glutamic acid at position 255, for example, have been shown to be key determinants of an exosite on that is generated by heparin binding, and that promotes the rapid, increased inhibition of FIXa by compared to the inhibition observed with AT-III alone (Izaguirre et al., (2006) *J. Bio Chem* 281:13424-13432).

Mutational studies also have given some indication of which residues in Factor IXa are involved in the interaction with AT-III/heparin. For example, modification of the arginine at position 318 of the mature FIX polypeptide (corresponding to position 150 by chymotrypsin numbering) reduces the reactivity of this mutant with AT-III/heparin by 33-fold to 70-fold (Yang, L. et al., (2003) *J. Biol. Chem.* 278(27):25032-8). The impairment of the reactivity between the FIXa mutant and AT-III is not as noticeable when AT-III is not bound to heparin, however, indicating that the interaction between the arginine at position 318 of the mature FIXa polypeptide and AT-III is effected when AT-III is in the heparin-activated conformation.

ii. Heparin

Heparin can inhibit the activity of FIXa in the intrinsic tenase complex in both an AT-III-dependent manner, as discussed above, and an AT-III-independent manner. Studies indicate that the AT-III-independent inhibition of FIXa activity by heparin is the result of oligosaccharide binding to an exosite on FIXa that disrupts the FVIIIa-FIXa interaction (Yuan et al., (2005) *Biochem.* 44:3615-3625, Misenheimer et al., (2007) *Biochem.* 46:7886-7895, Misenheimer et al. (2010) *Biochem.* 49:9977-10005). The heparin-binding exosite is in the Factor aa protease domain, in an electropositive region extending from the arginine at position 338 (corresponding to position 170 by chymotrypsin numbering) to at least the arginine at position 403 (corresponding to position 233 by chymotrypsin numbering). This exosite overlaps with a region of FIXa that is critical to the interaction of FIXa with its cofactor, FVIIIa. Thus, binding of heparin to FIXa inhibits the interaction of FIXa with FVIIIa, thus reducing the intrinsic tenase activity.

iii. Exemplary FIX Polypeptides with Increased Resistance to AT-III and Heparin

Modifications can be made to a FIX polypeptide that increase its resistance to AT-III, heparin and/or the AT-III/heparin complex. Generally, such modified FIX polypeptides retain at least one activity of a FIX polypeptide. Typically, such modifications include one or more amino acid substitutions at any position of the FIX polypeptide that is involved in the interaction of FIXa with AT-III, heparin an/or the AT-III/heparin complex. Such modifications can, for example, result in a reduced rate of interaction of the modified FIXa polypeptide with AT-III alone, a reduced rate of interaction of the modified FIXa polypeptide to the AT-III/heparin complex, and/or a reduced binding affinity of the modified FIXa polypeptide for heparin alone. In some examples, the modification(s) introduces one or more non-native glycosylation sites. The carbohydrate moiety that is linked to the new glycosylation site can sterically hinder the interaction of the modified FIX with the AT-III/heparin complex, resulting in increased resistance of the modified FIX polypeptide to the inhibitory effects of AT-III/heparin. The modified FIXa polypeptides therefore exhibit increased resistance to the naturally inhibitory effects of AT-III, AT-III/heparin and/or heparin with respect to intrinsic tenase activity. When evaluated in an appropriate in vitro assay, or in vivo, such as following administration to a subject as a pro-coagulant therapeutic, the modified FIX polypeptides display increased coagulant activity as compared with unmodified FIX polypeptides.

As described herein below, one of skill in the art can empirically or rationally design modified FIXa polypeptides that display increased resistance to AT-III, AT-III/heparin and/or heparin. Such modified FIX polypeptides can be tested in assays known to one of skill in the art to determine if the modified FIX polypeptides display increased resistance to AT-III, AT-III/heparin and/or heparin. For example, the modified FIX polypeptides can be tested for binding to AT-III, AT-III/heparin and/or heparin. Generally, a modified FIX polypeptide that has increased resistance to AT-III, AT-III/heparin and/or heparin will exhibit decreased binding and/or decreased affinity for heparin and/or a decreased rate of interaction with AT-III and/or AT-III/heparin. Typically, such assays are performed with the activated form of FIX (FIXa), and in the presence or absence of the cofactor, FVIIIa, and phospholipids.

Provided herein are modified FIX polypeptides exhibiting increased resistance to AT-III, AT-III/heparin and/or heparin. FIX polypeptide variants provided herein have been modified at one or more of amino acid positions 202, 203, 204, 205, 228, 239, 257, 260, 293, 312, 316, 318, 319, 321, 333, 338, 342, 346, 400, 403 or 410 (corresponding to amino acid positions 38, 39, 40, 41, 63, 74, 92, 95, 126, 143, 145, 148, 150, 151, 153, 165, 170, 174, 178, 230, 233 and 240 respectively, by chymotrypsin numbering). These amino acid residues can be modified such as by amino acid replacement, deletion or substitution. The identified residues can be replaced or substituted with any another amino acid. Alternatively, amino acid insertions can be used to alter the conformation of a targeted amino acid residue or the protein structure in the vicinity of a targeted amino acid residue.

Any amino acid residue can be substituted for the endogenous amino acid residue at the identified positions. Typically, the replacement amino acid is chosen such that it interferes with the interaction between FIX and AT-III or heparin. For example, modifications can be made at amino acid positions 260, 293, 333, 338, 346, 400 and 410 (corresponding to amino acid positions 95, 126, 165, 170, 178, 230, 233 and 240, respectively, by chymotrypsin numbering) to interfere with the interaction of the FIX polypeptide with heparin. In other examples, modifications are made at amino acid positions 203, 204, 205, 228, 239, 312, 314, 316, 318, 319, 321 and 342 (corresponding to amino acid positions 39, 40, 41, 63, 74, 143, 145, 148, 150, 151, 153 and 174, respectively, by chymotrypsin numbering) to interfere with the interaction of the FIX polypeptide with AT-III.

In some examples, a new glycosylation site is introduced by amino acid replacement. The carbohydrate moiety that is linked to the new glycosylation site can sterically hinder the interaction of the modified FIX with the AT-III/heparin complex, resulting in increased resistance of the modified FIX polypeptide to the inhibitory effects of AT-III/heparin. For example, the glutamic acid (Glu, E) at position 410 (corresponding to position 240 by chymotrypsin numbering) can be replaced with an asparagine (Asn, N) to introduce a new glycosylation site at position 410. In other examples, the glutamic acid (Glu, E) at position 239 (corresponding to position 74 by chymotrypsin numbering) is replaced with an asparagine (Asn, N) to introduce a new glycosylation site at position 239. Other mutations that introduce a new glycosylation site to increase resistance to AT-III/heparin include, for example, D203N/F205T, R318N/A320S, N260S and F314N/K316S (corresponding to D39N/F41T, R150N/A152S, N95S and F145N/K148S by chymotrypsin numbering).

In other examples in which modifications are made to increase resistance to AT-III, AT-III/heparin and/or heparin, the valine residue at position 202 (corresponding to position 38 by chymotrypsin numbering) is replaced with a methionine (Met, M) or tyrosine (Tyr, Y); the aspartic acid (Asp, D) at position 203 (corresponding to position 39 by chymotrypsin numbering) is replaced with a methionine (Met, M) or tyrosine (Tyr, Y); the alanine (Ala, A) at position 204 (corresponding to position 40 by chymotrypsin numbering) is replaced with a methionine (Met, M) or tyrosine (Tyr, Y); the glutamic acid at position 239 (corresponding to position 74 by chymotrypsin numbering) is replaced with serine (Ser, S), alanine (Ala, A), arginine (Arg, R), or lysine (Lys, K); the histidine at position 257 (corresponding to position 92 by chymotrypsin numbering) is replaced with phenylalanine (Phe, F), tyrosine (Tyr, Y), glutamic acid (Glu, E) or serine (Ser, S); the lysine (Lys, K) at position 293 (corresponding to position 143 by chymotrypsin numbering) is replaced with alanine (Ala, A) or glutamine (Gln, Q); the arginine (Arg, R) at position 312 (corresponding to position 143 by chymotrypsin numbering) is replaced with alanine (Ala, A) or glutamine (Gln, Q); the lysine at position 316 (corresponding to 148 by chymotrypsin numbering) is replaced with asparagine (Asn, N), alanine (Ala, A), glutamic acid (Glu, E), serine (Ser, S) or methionine (Met, M); the arginine (Arg, R) at position 318 (corresponding to position 150 by chymotrypsin numbering) is replaced with alanine (Ala, A), glutamic acid (Glu, E) tyrosine (Tyr, Y), phenylalanine (Phe, F) or tryptophan (Trp, W); the arginine (Arg, R) at position 333 (corresponding to position 165 by chymotrypsin numbering) is replaced with alanine (Ala, A) or glutamic acid (Glu, E); the arginine (Arg, R) at position 338 (corresponding to position 170 by chymotrypsin numbering) is replaced with alanine (Ala, A) or glutamic acid (Glu, E); the lysine (Lys, K) at position 400 (corresponding to position 230 by chymotrypsin numbering) is replaced with alanine (Ala, A) or glutamic acid (Glu, E); and/or the arginine (Arg, R) at position 403 (corresponding to position 233 by chymotrypsin numbering) is replaced with alanine (Ala, A), glutamic acid (Glu, E) or aspartic acid (Asp, D).

Provided herein are modified FIX polypeptides that contains an amino acid replacement at residue R318 or at a residue in a FIX polypeptide corresponding to 318 that is a tyrosine, e.g., R318Y, or is a conservative amino acid replacement thereof. For example, conservative amino acid residues for tyrosine include, but are not limited to, phenylalanine (F) or tryptophan (W). Also provided are modified FIX polypeptides that contains an amino acid replacement at residue R403 or at a residue in a FIX polypeptide corresponding to 403 that is a glutamic acid, e.g., R403E, or is a conservative amino acid replacement thereof. For example, conservative amino acid residues for glutamic acid include, but are not limited to, aspartic acid (D).

In a further embodiment, combination mutants can be generated. Included among such combination mutants are those having two or more mutations at amino acid positions 202, 203, 204, 257, 239, 293, 312, 316, 318, 333, 338, 400, 403 and 410 (corresponding to amino acid positions 38, 39, 40, 74, 92, 126, 143, 148, 150, 165, 170, 230, 233 and 240, respectively, by chymotrypsin numbering). For example, a modified FIX polypeptide can possess amino acid substitutions at 2, 3, 4, 5 or more of the identified positions. Hence, a modified polypeptide can display 1, 2, 3, 4, 5 or more mutations that can result in increased resistance of the modified FIX polypeptide to the inhibitory effects of AT-III, AT-III/heparin and/or heparin. Any one or more of the mutations described herein to increase resistance of the modified FIX polypeptide to the inhibitory effects of AT-III, AT-III/heparin and/or heparin can be combined.

Table 6 provides non-limiting examples of exemplary amino acid replacements at the identified residues, corresponding to amino acid positions of a mature FIX polypeptide as set forth in SEQ ID NO:3. Included amongst these are exemplary combination mutations. As noted, such FIX polypeptides are designed to increase resistance to AT-III, AT-III/heparin and/or heparin, and therefore have increased coagulant activity in vivo, ex vivo, or in in vitro assays that include ATIII, heparin/ATIII, heparin, plasma, serum, or blood. In reference to such mutations, the first amino acid (one-letter abbreviation) corresponds to the amino acid that is replaced, the number corresponds to the position in the mature FIX polypeptide sequence with reference to SEQ ID NO:3, and the second amino acid (one-letter abbreviation) corresponds to the amino acid selected that replaces the first amino acid at that position. The amino acid positions for mutation also are referred to by the chymotrypsin numbering scheme. In Table 6 below, the sequence identifier (SEQ ID NO) is identified in which exemplary amino acid sequences of the modified FIX polypeptide are set forth.

TABLE 6

| Mutation (Mature FIX Numbering) | Mutation (Chymotrypsin Numbering) | SEQ ID NO |
|---|---|---|
| R318A | R150A | 120 |
| R318E | R150E | 121 |
| R318Y | R150Y | 122 |
| R318F | R150F | 413 |
| R318W | R150W | 414 |
| R312Q | R143Q | 123 |
| R312A | R143A | 124 |
| R312Y | R143Y | 125 |
| R312L | R143L | 126 |
| V202M | V38M | 127 |
| V202Y | V38Y | 128 |
| D203M | D39M | 129 |
| D203Y | D39Y | 130 |
| A204M | A40M | 131 |
| A204Y | A40Y | 132 |
| K400A/R403A | K230A/R233A | 133 |
| K400E/R403E | K230E/R233E | 134 |
| R403A | R233A | 135 |
| R403E | R233E | 136 |
| R403D | R233D | 417 |
| K400A | K230A | 137 |

TABLE 6-continued

| Mutation (Mature FIX Numbering) | Mutation (Chymotrypsin Numbering) | SEQ ID NO |
|---|---|---|
| K400E | K230E | 138 |
| K293E | K126E | 139 |
| K293A | K126A | 140 |
| R333A | R165A | 141 |
| R333E | R165E | 142 |
| R333S | R165S | 186 |
| R338A | R170A | 143 |
| R338E | R170E | 144 |
| R338L | R170L | 187 |
| R338A/R403A | R170A/R233A | 145 |
| R338E/R403E | R170E/R233E | 146 |
| K293A/R403A | K126A/R233A | 147 |
| K293E/R403E | K126E/R233E | 148 |
| K293A/R338A/R403A | K126A/R170A/R233A | 149 |
| K293E/R338E/R403E | K126E/R170E/R233E | 150 |
| R318A/R403A | R150A/R233A | 151 |
| R318E/R403E | R150E/R233E | 152 |
| R318Y/R338E/R403E | R150Y/R170E/R233E | 156 |
| R318Y/R338E | R150Y/R170E | 188 |
| R318N/A320S | R150N/A152S | 119 |
| K316N | K148N | 189 |
| K316A | K148A | 190 |
| K316E | K148E | 191 |
| K316S | K148S | 192 |
| K316M | K148M | 193 |
| E239N | E74N | 109 |
| E239S | E74S | 194 |
| E239A | E74A | 195 |
| E239R | E74R | 196 |
| E239K | E74K | 197 |
| H257F | H92F | 198 |
| H257Y | H92Y | 199 |
| H257E | H92E | 200 |
| H257S | H92S | 201 |
| E410N | E240N | 108 |
| N260S | N95S | 116 |
| F314N/K316S | F145N/K148S | 113 |

The modifications described herein to increase resistance to an inhibitor, such as AT-III and/or heparin, can be combined with any other mutation described herein or known in the art. Typically, the resulting modified FIX polypeptide exhibits increased coagulant activity compared to an unmodified FIX polypeptide. For example, one or more modifications that increase resistance to an inhibitor, such as AT-III and/or heparin, can be combined with modification(s) that introduce a non-native glycosylation site, eliminate one or more native glycosylation sites, eliminate one or more of the native sulfation, phosphorylation or hydroxylation sites, increase catalytic activity, increase intrinsic activity, increase binding to phospholipids, or improve pharmacokinetic and/or pharmacodynamic properties. The resulting modified FIX polypeptide typically exhibits increased coagulant activity compared to an unmodified FIX polypeptide.

Modified FIX polypeptides that have increased resistance for AT-III alone, the AT-III/heparin complex and/or heparin alone, can exhibit a reduction in the affinity for heparin, the extent of inhibition under specified conditions, or in the second order rate constant for inhibition by ATM or heparin/ATIII at least or at least about 1%, 2%, 3%, 4%, 5%, 6%, 7%, 8%, 9%, 10%, 20%, 30%, 40%, 50%, 60%, 70%, 80%, 90%, 95%, 99% or more compared to the affinity, extent of inhibition, or the second order rate constant for inhibition of unmodified or wild-type FIX polypeptide either in vivo or in vitro. Thus, the modified FIX polypeptides can exhibit increased resistance to AT-III alone, the AT-III/heparin complex and/or heparin alone that is at least or at least about 1%, 2%, 3%, 4%, 5%, 6%, 7%, 8%, 9%, 10%, 20%, 30%, 40%, 50%, 60%, 70%, 80%, 90%, 100%, 200%, 300%, 400%, 500%, or more of the resistance exhibited by an unmodified FIX polypeptide. Increased resistance to AT-III, the AT-III/heparin complex and/or heparin by such modified FIX polypeptides also can be manifested as increased coagulation activity or improved duration of coagulation activity in vivo or in vitro in the presence of AT-III, the AT-III/heparin complex, heparin, blood, plasma, or serum. The coagulation activity of the modified FIX polypeptides can be increased by at least about 1%, 2%, 3%, 4%, 5%, 6%, 7%, 8%, 9%, 10%, 20%, 30%, 40%, 50%, 60%, 70%, 80%, 90%, 100%, 200%, 300%, 400%, 500%, or more compared to the coagulation activity of unmodified or wild-type FIX polypeptide either in vivo or in vitro. Modified FIX polypeptides containing modifications that increase resistance to AT-III, the heparin/AT-III complex, and/or heparin also can exhibit an enhanced therapeutic index compared with unmodified FIXa.

c. Mutations to Increase Catalytic Activity

The modified FIX polypeptides provided herein can contain one or more modifications to increase the catalytic activity of the polypeptide compared to an unmodified FIX. For example, modifications can be made to the amino acids that are involved in the interaction of FIX with its cofactor, FVIIIa, such that the resulting modified FIX polypeptide has increased affinity for FVIIIa, and thereby displays increased activity toward FX under conditions in which FVIIIa is not present at saturating concentrations. Modifications also can be made to the protease domain of the FIX polypeptide, such that the activity or catalytic efficiency of the modified FIX polypeptide for activation of FX, in the presence and/or absence of the co-factor FVIIIa, is increased compared to the activity or catalytic efficiency of the unmodified polypeptide.

Exemplary modifications that can be included in the modified FIX polypeptides provided herein include amino acid replacements at positions 259, 265, 345, 410 and 412 (corresponding to 94, 98, 177, 240 and 242 by chymotrypsin numbering). The amino acids at these positions can be replaced by any other amino acid residue. In some examples, the tyrosine at position 259 is replaced with a phenylalanine; the lysine at position 265 is replaced with a threonine; and for the tyrosine at position 345 is replaced with a threonine. In further example, the glutamic acid at position 410 is replaced with a glutamine, serine, alanine or aspartic acid. In one example, the threonine at position 412 is replaced with a valine or an alanine.

The above mentioned modifications are exemplary only. Many other modifications described herein also result in increased catalytic activity. For example, modifications that are introduced into the FIX polypeptide to increase resistance to an inhibitor, such as AT-III and/or heparin, introduce a non-native glycosylation site, eliminate one or more native glycosylation sites, eliminate one or more of the native sulfation, phosphorylation or hydroxylation sites, increase intrinsic activity, increase binding to phospholipids, decrease binding to LRP, and/or improve pharmacokinetic and/or pharmacodynamic properties, can also result in a modified FIX polypeptide that exhibits increased activity.

Table 7 provides non-limiting examples of exemplary amino acid replacements at the identified residues, corresponding to amino acid positions of a mature FIX polypeptide as set forth in SEQ ID NO:3. In reference to such mutations, the first amino acid (one-letter abbreviation) corresponds to the amino acid that is replaced, the number corresponds to the position in the mature FIX polypeptide sequence with reference to SEQ ID NO:3, and the second amino acid (one-letter abbreviation) corresponds to the amino acid selected that replaces the first amino acid at that position. The amino acid positions for mutation also are referred to by the chymotrypsin numbering scheme. In Table 7 below, the sequence identifier (SEQ ID NO) is identified in which exemplary amino acid sequences of the modified FIX polypeptide are set forth.

TABLE 7

| Mutation (Mature FIX Numbering) | Mutation (Chymotrypsin Numbering) | SEQ ID NO |
|---|---|---|
| T412A | T242A | 202 |
| T412V | T242V | 203 |
| E410Q | E240Q | 174 |
| E410S | E240S | 175 |
| E410A | E240A | 176 |
| E410D | E240D | 206 |
| Y259F/K265T/Y345T | Y94F/K98T/Y177T | 216 |

The modifications described herein to increase catalytic activity can be combined with any other mutation described herein or known in the art. Typically, the resulting modified FIX polypeptide exhibits increased coagulant activity compared to an unmodified FIX polypeptide. For example, one or more modifications that increase catalytic activity can be combined with modification(s) that increase resistance to an inhibitor, such as AT-III and/or heparin, introduce a non-native glycosylation site, eliminate one or more native glycosylation sites, eliminate one or more of the native sulfation, phosphorylation or hydroxylation sites, increase intrinsic activity, increase binding to phospholipids, or improve pharmacokinetic and/or pharmacodynamic properties. The resulting modified FIX polypeptide typically exhibits increased coagulant activity compared to an unmodified FIX polypeptide.

Modified FIX polypeptides that have increased catalytic activity can exhibit at least or about 1%, 2%, 3%, 4%, 5%, 6%, 7%, 8%, 9%, 10%, 20%, 30%, 40%, 50%, 60%, 70%, 80%, 90%, 95%, 99% or more activity compared to the catalytic activity of unmodified or wild-type FIX polypeptide either in vivo or in vitro. Increased catalytic activity of such modified FIX polypeptides also can be manifested as increased coagulation activity, duration of coagulation activity and/or enhanced therapeutic index. The coagulation activity of the modified FIX polypeptides can be increased by at least or at least about 1%, 2%, 3%, 4%, 5%, 6%, 7%, 8%, 9%, 10%, 20%, 30%, 40%, 50%, 60%, 70%, 80%, 90%, 100%, 200%, 300%, 400%, 500%, or more compared to the coagulation activity of unmodified or wild-type FIX polypeptide either in vivo or in vitro.

d. Mutations to Decrease LRP Binding

FIXa can be cleared from systemic circulation by binding the low-density lipoprotein receptor-related protein (LRP), which is a membrane glycoprotein that is expressed on a variety of tissues, including liver, brain, placenta and lung. Thus, provided herein are modified FIX polypeptides that exhibit decreased binding to the LRP. This can result in improved pharmacokinetic properties of the modified FIX polypeptide, including, for example, i) decreased clearance, ii) altered volume of distribution, iii) enhanced in vivo recovery, iv) enhanced total protein exposure in vivo (i.e., AUC), v) increased serum half-life (α, β, and/or γ phase), and/or vi) increased mean resonance time (MRT). Such modified FIX polypeptides can exhibit increased coagulant activity.

The modified FIX polypeptide provided herein can contain one or more modifications in the LRP-binding site. This binding site is postulated to be located in a loop in the protease domain spanning residues 342 to 346 of the mature FIX polypeptide set forth in SEQ ID NO:3. Modification of one or more of the residues at positions 342-346 (corresponding to positions 174-178 by chymotrypsin numbering), such as by amino acid replacement, insertion or deletion, can interfere with the interaction between the modified FIX polypeptide and LRP, resulting in decreased binding affinity. The binding of the modified FIX polypeptides to LRP can be tested using assays known to one of skill in the art (see, e.g. Rohlena et al., (2003) J. Biol. Chem. 278:9394-9401). The resulting improved pharmacokinetic properties also can be tested using well known in vivo assays, including those described below.

Exemplary modifications that can be included in the modified FIX polypeptides provided herein include amino acid replacements at positions 343, 344, 345 and 346 (corresponding to 175, 176, 177 and 178 by chymotrypsin numbering). The amino acids at these positions can be replaced by any other amino acid residue. In some examples, the threonine at position 343 is replaced with a glutamine, glutamic acid, aspartic acid or arginine; the phenylalanine at position 344 is replaced with an isoleucine; the tyrosine at position 345 is replaced with a threonine, alanine or an alanine; and/or the asparagine at position 346 is replaced with an aspartic acid or a tyrosine. Any one or more of these exemplary amino acid replacements can be combined with each other or with other modifications described herein.

Provided herein are modified FIX polypeptides that contains an amino acid replacement at residue T343 or at a residue in a FIX polypeptide corresponding to 343 that is an arginine, e.g., T343R, or is a conservative amino acid replacement thereof. For example, conservative amino acid residues for arginine include, but are not limited to, lysine (K).

Table 8 provides non-limiting examples of exemplary amino acid replacements at the identified residues, corresponding to amino acid positions of a mature FIX polypeptide as set forth in SEQ ID NO:3. In reference to such mutations, the first amino acid (one-letter abbreviation) corresponds to the amino acid that is replaced, the number corresponds to the position in the mature FIX polypeptide sequence with reference to SEQ ID NO:3, and the second amino acid (one-letter abbreviation) corresponds to the amino acid selected that replaces the first amino acid at that position. The amino acid positions for mutation also are referred to by the chymotrypsin numbering scheme. In Table 8 below, the sequence identifier (SEQ ID NO) is identified in which exemplary amino acid sequences of the modified FIX polypeptide are set forth.

TABLE 8

| Mutation (Mature FIX Numbering) | Mutation (Chymotrypsin Numbering) | SEQ ID NO |
|---|---|---|
| N346D | N178D | 207 |
| N346Y | N178Y | 208 |
| T343R | T175R | 209 |
| T343E | T175E | 210 |
| T343D | T175D | 416 |
| T343Q | T175Q | 211 |
| F342I | F174I | 212 |
| Y345A | Y177A | 213 |
| Y345T | Y177T | 214 |
| T343R/Y345T | T175R/Y177T | 215 |
| T343R/N346D | T175R/N178D | 409 |
| T343R/N346Y | T175R/N178Y | 410 |

The modifications described herein to decrease binding to LRP can be combined with any other mutation described herein or known in the art. Typically, the resulting modified FIX polypeptide exhibits increased coagulant activity compared to an unmodified FIX polypeptide. For example, one or more modifications that decrease binding to LRP can be combined with modification(s) that increase resistance to an inhibitor, such as AT-III and/or heparin, increase catalytic activity, introduce a non-native glycosylation site, eliminate one or more native glycosylation sites, eliminate one or more of the native sulfation, phosphorylation or hydroxylation sites, increase activity in the presence and/or absence of FVIIIa, increase binding to phospholipids, or improve pharmacokinetic and/or pharmacodynamic properties. The resulting modified FIX polypeptide typically exhibits increased coagulant activity compared to an unmodified FIX polypeptide.

Modified FIX polypeptides that have decreased binding to LRP can exhibit at a decrease of at least or about 1%, 2%, 3%, 4%, 5%, 6%, 7%, 8%, 9%, 10%, 20%, 30%, 40%, 50%, 60%, 70%, 80%, 90%, 95%, 99% or more compared to the binding of unmodified or wild-type FIX polypeptide to LRP in vitro. Decreased binding to LRP by such modified FIX polypeptides can result in improved pharmacokinetic properties, such as i) decreased clearance, ii) altered volume of distribution, iii) enhanced in vivo recovery, iv) enhanced total protein exposure in vivo (i.e., AUC), v) increased serum half-life ($\alpha\gamma$, $\beta$, and/or $\gamma$ phase), and/or vi) increased mean resonance time (MRT). Further, such alterations can result in increased coagulant activity, duration of coagulation activity and/or enhanced therapeutic index. The coagulation activity of the modified FIX polypeptides can be increased by at least or at least about 1%, 2%, 3%, 4%, 5%, 6%, 7%, 8%, 9%, 10%, 20%, 30%, 40%, 50%, 60%, 70%, 80%, 90%, 100%, 200%, 300%, 400%, 500%, or more compared to the coagulation activity of unmodified or wild-type FIX polypeptide either in vivo or in vitro.

e. Other Mutations to Alter Posttranslational Modification

Wild-type FIX is post translationally modified upon expression in mammalian cells. The Factor IX precursor polypeptide undergoes extensive posttranslational modification to become the mature zymogen that is secreted into the blood. Such posttranslational modifications include $\gamma$-carboxylation, $\beta$-hydroxylation, O- and N-linked glycosylation, sulfation and phosphorylation. As discussed above, the levels of glycosylation can be altered by, for example, introducing new non-native glycosylation sites and/or eliminating native glycosylation sites. Similarly, other posttranslational modifications can be altered, such as by introducing and/or eliminating $\gamma$-carboxylation, $\beta$-hydroxylation, sulfation and/or phosphorylation sites.

Any one or more of the native $\gamma$-carboxylation, $\beta$-hydroxylation, sulfation or phosphorylation sites can be eliminated, such as by amino acid replacement or deletion. For example, unmodified FIX polypeptides can be modified by amino acid replacement of any one or more of the twelve glutamic acid residues (corresponding to positions 7, 8, 15, 17, 20, 21, 26, 27, 30, 33, 36 and 40 of the mature FIX set forth in SEQ ID NO:3) in the Gla domain. These residues typically are $\gamma$-carboxylated to $\gamma$-carboxyglutamyl (or Gla) in wild-type FIX. Thus, removal of the glutamic acid residues, such as by amino acid substitution or deletion, can reduce the level of $\gamma$-carboxylation in a modified FIX polypeptide compared to the unmodified FIX polypeptide. Similarly, the aspartic acid residue at position 64, which normally is $\beta$-hydroxylated in wild-type FIX, can be removed, such as by amino acid substitution or deletion. Additional post-translational modification sites that can be eliminated include, for example, the tyrosine at position 155, which typically is sulfated in wild-type FIX, and the serine residue at position 158, which typically is phosphorylated in wild-type FIX.

In other examples, non-native post-translational modification sites can be introduced, such as by amino acid replacement or insertion. For example, additional glutamic acid residues can be introduced into the Gla domain. Such glutamic acid residues could be $\gamma$-carboxylated to $\gamma$-carboxyglutamyl (or Gla) in the modified FIX polypeptide upon expression in, for example, a mammalian cell. Similarly, one or more non-native $\beta$-hydroxylation, sulfation or phosphorylation sites can be introduced.

Provided herein are modified FIX polypeptides that have one or more of the native posttranslational modification sites eliminated. The modified FIX polypeptides that have been modified to eliminate one or more post-translational modification sites, including $\gamma$-carboxylation, $\beta$-hydroxylation, sulfation and/or phosphorylation sites, retain at least one activity of the unmodified FIX polypeptide. In some examples, the modified FIX polypeptide retains at least or at least about 5%, 10%, 20%, 30%, 40%, 50%, 60%, 70%, 80%, 90%, 95% or more of the catalytic activity of the unmodified FIX polypeptide. In other examples, the modified FIX polypeptide retains at least or at lest about 5%, 10%, 20%, 30%, 40%, 50%, 60%, 70%, 80%, 90%, 95% or more of the binding activity for FVIIIa of the unmodified FIX polypeptide. In some assays and/or under some conditions, the modified FIX polypeptides can exhibit increased activity compared with the unmodified FIX protein (e.g., increased pharmacodynamic activity in vivo, and/or activity in the presence of AT-III/heparin or plasma).

Provided herein are modified FIX polypeptides that contains an amino acid replacement at residue Y155 or at a residue in a FIX polypeptide corresponding to 155 that is a phenylalanine, e.g., Y155F, or is a conservative amino acid replacement thereof. For example, conservative amino acid residues for phenylalanine include, but are not limited to, methionine (M), leucine (L) or tyrosine (Y).

Table 9 provides non-limiting examples of exemplary amino acid replacements, corresponding to amino acid positions of a mature FIX polypeptide as set forth in SEQ ID NO:3, that are included in a modified FIX polypeptide to eliminate a native $\beta$-hydroxylation, sulfation and/or phosphorylation sites at positions 64, 155 and 158, respectively. In Table 9 below, the sequence identifier (SEQ ID NO) is identified in which exemplary amino acid sequences of the modified FIX polypeptide are set forth.

TABLE 9

| Mutation (Mature FIX Numbering) | Mutation (Chymotrypsin Numbering) | SEQ ID NO |
| --- | --- | --- |
| D64N | D[64]N | 83 |
| D64A | D[64]A | 84 |
| Y155F | Y[155]F | 76 |
| Y155H | Y[155]H | 93 |
| Y155Q | Y[155]Q | 94 |
| T155L | Y[155]L | 415 |
| S158A | S[158]A | 95 |
| S158D | S[158]D | 96 |
| S158E | S[158]E | 97 |

The modifications described herein to eliminate $\beta$-hydroxylation, sulfation and/or phosphorylation sites can be combined with any other mutation described herein or known in the art. Typically, the resulting modified FIX polypeptide exhibits increased coagulant activity compared to an unmodified FIX polypeptide. For example, one or more modifications that eliminate one or more native $\beta$-hydroxylation, sulfation and/or phosphorylation sites can be combined with modification(s) that increase resistance to an inhibitor, such as AT-III and/or heparin, alter glycosylation, such as increase glycosylation, increase catalytic activity, increase intrinsic activity, increase binding to phospholipids, or improve pharmacokinetic and/or pharmacodynamic properties.

The modified FIX polypeptides provided herein that eliminate one or more native β-hydroxylation, sulfation and/or phosphorylation sites retain at least one activity of FIX, such as, for example, catalytic activity for its substrate, FX, or binding to the co-factor, FVIIIa. Typically, the modified FIX polypeptides provided herein retain at least or at least about 5%, 10%, 20%, 30%, 40%, 50%, 60%, 70%, 80%, 90%, 95% or more of the catalytic activity exhibited by an unmodified FIX polypeptide. In some instances, the coagulant activity of the modified FIX polypeptides is increased by at least or at least about 1%, 2%, 3%, 4%, 5%, 6%, 7%, 8%, 9%, 10%, 20%, 30%, 40%, 50%, 60%, 70%, 80%, 90%, 100%, 200%, 300%, 400%, 500%, or more compared to the coagulation activity of unmodified or wild-type FIX polypeptide either in vivo or in vitro.

2. Combination Modifications

The modified FIX polypeptides provided herein that contain one or more non-native glycosylation sites, have one or more native glycosylation sites eliminated, have one or more native β-hydroxylation, sulfation and/or phosphorylation sites eliminated, or that have modifications that can result in increased resistance to inhibitors, such as AT-III, AT-III/heparin and/or heparin, compared to a wild-type FIX polypeptide, also can contain other modifications. In some examples, the modified FIX polypeptides contain modifications that introduce one or more non-native glycosylation sites and also contain modifications that interfere with the interaction between FIX and inhibitors, such as AT-III, the AT-III/heparin complex and/or and heparin. In other examples, modifications that eliminate one or more native β-hydroxylation, sulfation and/or phosphorylation sites can be combined with modifications that increase resistance to inhibitors, and/or modifications that introduce one or more glycosylation sites. Thus, one or more of the mutations set forth in Tables 3-9 above, can be combined with any of the other mutations set forth in Tables 3-9 above. Thus, included among the modified FIX polypeptides provided herein are those that exhibit increased glycosylation, such as N-glycosylation; increased resistance to AT-III, AT-III/heparin, and/or heparin; decreased β-hydroxylation, sulfation and/or phosphorylation; and/or increased catalytic activity compared with an unmodified FIX polypeptide.

Further, any of the modified FIX polypeptides provided herein can contain any one or more additional modifications. In some examples, the additional modifications result in altered properties and/or activities compared to an unmodified FIX polypeptide. Typically, such additional modifications are those that themselves result in an increased coagulant activity of the modified polypeptide and/or increased stability of the polypeptide. Accordingly, the resulting modified FIX polypeptides typically exhibit increased coagulant activity.

The additional modifications can include, for example, any amino acid substitution, deletion or insertion known in the art, typically any that increases the coagulant activity and/or stability of the FIX polypeptide. Any modified FIX polypeptide provided herein can contain 1, 2, 3, 4, 5, 6, 7, 8, 9, 10, 11, 12, 13, 14, 15, 16, 17, 18, 19, 20 or more additional amino acid modifications. Typically, the resulting modified FIX polypeptide retains at least one activity of the wild-type or unmodified polypeptide, such as, for example, catalytic activity, or binding to the co-factor, FVIIIa.

Additional modifications in the primary sequence can be made to the FIX polypeptide to effect post-translational modifications. For example, the modified FIX polypeptides provided herein can contain non-native glycosylation sites including and other than those described above, such as any of those described in the art, including non-native O-linked or S-linked glycosylation sites described in U.S. Patent Publication No. 20080280818, or the non-native glycosylation sites described in International Patent Publication Nos. WO20091300198 and WO2009137254.

In other examples, the additional modification can be made to the FIX polypeptide sequence such that its interaction with other factors, molecules and proteins is altered. For example, the amino acid residues that are involved in the interaction with Factor X can be modified such that the affinity and/or binding of the modified FIX polypeptide to FX is increased. Other modifications include, but are not limited to, modification of amino acids that are involved in interactions with FVIIIa, heparin, antithrombin III and phospholipids.

Additional modifications also can be made to a modified FIX polypeptide provided herein that alter the conformation or folding of the polypeptide. These include, for example, the replacement of one or more amino acids with a cysteine such that a new disulphide bond is formed, or modifications that stabilize an α-helix conformation, thereby imparting increased activity to the modified FIX polypeptide.

Modifications also can be made to introduce amino acid residues that can be subsequently linked to a moiety, such as one that acts to increase stability of the modified FIX polypeptide. For example, cysteine residues can be introduced to facilitate conjugation to a polymer, such polyethylene glycol (PEG) (International Pat. Pub. No. WO2009140015). The stability of a FIX polypeptide also can be altered by modifying potential proteolytic sites, such as removing potential proteolytic sites, thereby increasing the resistance of the modified FIX polypeptide to proteases (see e.g. US Pat. Pub. No. 20080102115).

Additionally, amino acids substitutions, deletions or insertions can be made in the endogenous Gla domain such that the modified FIX polypeptide displays increased binding and/or affinity for phospholipid membranes. Such modifications can include single amino acid substitution, deletions and/or insertions, or can include amino acid substitution, deletion or insertion of multiple amino acids. For example, all or part of the endogenous Gla domain can be replaced with all or part of a heterologous Gla domain. In other examples, the modified FIX polypeptides provided herein can display deletions in the endogenous Gla domain, or substitutions in the positions that are normally gamma-carboxylated. Alternatively, amino acid substitutions can be made to introduce additional, potential gamma-carboxylation sites.

The following sections describe non-limiting examples of exemplary modifications described in the art to effect increased stability and/or coagulant activity of a FIX polypeptide. As discussed above, such modifications also can be additionally included in any modified FIX polypeptide provided herein. The amino acid positions referenced below correspond to the mature FIX polypeptide as set forth in SEQ ID NO:3. Corresponding mutations can be made in other FIX polypeptides, such as allelic, species or splice variants of the mature FIX polypeptide set forth in SEQ ID NO:3.

a. Modifications to Increase Activity

In one example, additional modifications can be made to a modified factor IX polypeptide provided herein that result in increased catalytic activity toward factor X. For example, modifications can be made to the amino acids that are involved in the interaction with its cofactor, FVIIIa, such that the resulting modified FIX polypeptide has increased affinity for FVIIIa, and thereby displays increased activity toward FX under conditions in which FVIIIa is not saturating. Modifications can also be made in FIX that increase the catalytic efficiency of FIXa polypeptides and/or the FIXa/FVIIIa complex, compared to the activity of the unmodified FIXa polypeptide or FIXa/FVIIIa complex, for activation of the substrate FX.

Examples of additional modifications that can be included in the modified FIX polypeptides provided herein to increase the intrinsic activity of the modified FIX polypeptide include, but are not limited to, those described in Hopfner et al., (1997) EMBO J. 16:6626-6635; Kolkman et al., (2000) Biochem. 39:7398-7405; Sichler et al., (2003) J. Biol. Chem. 278:4121-4126; Begbie et al., (2005) Thromb. Haemost. 94(6):1138-47; U.S. Pat. No. 6,531,298 and U.S. Patent Publication Nos. 20080167219 and 20080214461. Non-limiting examples of exemplary amino acid modifications described in the art that can result in increased intrinsic activity of the modified FIX polypeptide include any one or more of V86A, V86N, V86D, V86E, V86Q, V86G, V86H, V86I, V86L, V86M, V86F, V86S, V86T, V86W, V86Y, Y259F, A261K, K265T, E277V, E277A, E277N, E277D, E277Q, E277G, E277H, E277I, E277L, E277M, E277F, E277S, E277T, E277W, E277Y, R338A, R338V, R338I, R338F, R338W, R338S, R338T, Y345F, I383V, E388G. For example, a modified FIX polypeptide provided herein can contain the amino acid substitutions Y259F/K265T, Y259F/K265T/Y345F, Y259F/A261K/K265T/Y345F, Y259F/K265T/Y345F/I383V/E388G or Y259F/A261K/K265T/Y345F/I383V/E388G. In another example, the modified FIX polypeptides provided herein can contain modifications that remove the activation peptide (Δ155-177) (see, e.g. Begbie et al., (2005) Thromb. Haemost. 94(6):1138-47), which can both increase activity and decrease clearance in vivo.

b. Modifications that Increase Affinity for Phospholipids or Reduce Binding to Collagen The modified FIX polypeptides provided herein also can contain one or more additional modifications to increase affinity for phospholipids. The coagulant activity of FIX can be enhanced by increasing the binding and/or affinity of the polypeptide for phospholipids, such as those expressed on the surface of activated platelets. This can be achieved, for example, by modifying the endogenous FIX Gla domain. Modification can be effected by amino acid substitution at one or more positions in the Gla domain of a FIX polypeptide that result in a modified FIX polypeptide with increased ability to bind phosphatidylserine and other negatively charged phospholipids. Examples of additional modifications to increase phospholipid binding and/or affinity and that can be made to a modified FIX polypeptide provided herein, include, but are not limited to, those described in U.S. Pat. No. 6,017,882. For example, a modified FIX polypeptide provided herein can contain one or more modifications at amino acid positions 11, 12, 29, 33 and/or 34 (corresponding to a mature FIX polypeptide set forth in SEQ ID NO:3). Exemplary of such modifications are amino acid substitutions K5I, K5L, K5F, K5E, Q11E, Q11D, R16E, R29F and/or N34E, N34D, N34F, N34I, N34L, T35D and T35E.

In another aspect, the modified FIX polypeptides provided herein also can contain one or more additional modifications to reduce affinity for collagen. The coagulant activity of FIX can be enhanced by reducing the binding and/or affinity of the polypeptide for collagen IV, which is present on the surface of the extracellular matrix on endothelial cells. A reduced binding to collagen IV can result in increased circulation of the modified FIX polypeptides and, thus, increased coagulant activity in vivo. This can be achieved, for example, by modifying the FIX Gla domain at amino acid residues 3 to 11 of a mature FIX polypeptide set forth in SEQ ID NO:3, which are responsible for the interaction with collagen IV (Cheung et al., (1992) J. Biol. Chem. 267:20529-20531; Cheung et al., (1996) Proc. Natl. Acad. Sci. U.S.A. 93:11068-11073). Modification can be effected by amino acid substitution at one or more positions in the Gla domain of a FIX polypeptide that result in a modified FIX polypeptide with decreased ability to bind collagen N. Examples of additional modifications to increase phospholipid binding and/or affinity and that can be made to a modified FIX polypeptide provided herein, include, but are not limited to, those described in Schuettrumpf et al., (2005) Blood 105(6):2316-23; Melton et al., (2001) Blood Coagul. Fibrinolysis 12(4):237-43; and Cheung et al., (1996) Proc. Natl. Acad. Sci. U.S.A. 93:11068-11073. For example, a modified FIX polypeptide provided herein can contain are amino acid substitutions K5A and/or V10K.

c. Additional Modifications to Increase Resistance to Inhibitors

Additional modifications can be included that increase the activity of the FIX polypeptide by increasing the resistance of the modified FIX polypeptide to inhibitors, such as, for example, inhibition by antithrombin III (AT-III)/heparin. Typically, this can be achieved by modifying one or more residues that are involved in the interaction with AT-III, heparin or the AT-III/heparin complex. Exemplary of such modifications include those described, for example, in U.S. Pat. No. 7,125,841; U.S. Pat. Pub. No 20040110675; Int. Pat. Pub. No. WO2002040544; Chang, J. et al., (1998) J. Biol. Chem. 273(20):12089-94; Yang, L. et al., (2002) J. Biol. Chem. 277(52):50756-60; Yang, L. et al., (2003) J. Biol. Chem. 278(27):25032-8; Rohlena et al., (2003) J. Biol. Chem. 278 (11):9394-401; Sheehan et al., (2006) Blood 107(10):3876-82; Buyue et al. (2008) Blood 112:3234-3241. Non-limiting examples of modifications that can be included to decrease inhibition by AT-III and/or heparin, include, but are not limited to, modifications at amino acid positions corresponding to amino acid positions R252, H256, H257, K265, H268, K293, R318, R333, R338, K400, R403, K409 or K411 of a mature FIX polypeptide set forth in SEQ ID NO:3. For example, the FIX polypeptides provided herein can contain the amino acid substitutions R252A, H257A, H268A, K293A, R318A, R333A, R338A, K400A, R403A, R403E and/or K411A.

d. Additional Modifications to Alter Glycosylation

Modifications, in addition to those described above can be incorporated into the modified FIX polypeptides provided herein to alter the glycosylation of the modified FIX polypeptides compared to an unmodified FIX polypeptide. For example, the modified FIX polypeptides can contain one or more modifications that introduce one or more non-native glycosylation sites into the modified FIX polypeptide. Thus, when expressed in an appropriate system, the modified FIX polypeptides can exhibit altered glycosylation patterns compared to an unmodified FIX polypeptide. In some examples, the modified FIX polypeptides exhibit increased glycosylation compared to an unmodified FIX polypeptide, such as increased N-glycosylation or increased O-glycosylation Examples of additional modifications that can be included in the modified FIX polypeptides provided herein to alter the glycosylation profile of a FIX polypeptide include, but are not limited to, those described in International Published Application Nos. WO2009130198, WO2009051717 and WO2009137254. Exemplary modifications that can be included in a modified FIX polypeptide provided herein to increase glycosylation include, but are not limited to, Y1N, Y1N+S3T, S3N+K5S/T, G4T, G4N+L6S/T, K5N+E7T, L6N+E8T, E7N+F9T, F9N+Q11S/T, V10N+G12S/T, Q11N+N13T, G12N+L14S/T, L14N+R16T, E15T, E15N+ E17T; R16N+C18S/T, M19N+E21T; E20N+K22T, K22N, S24N+E26T; F25N+E27T; E26N+A28T; E27N+R29T; A28N+E30T; R29N+V31S/T, E30N+F32T; V31N+E33T; F32N+N34T, E33N, T35N+R37S/T, E36T; E36N; R37N, T39N+F41 S/T, E40N+W42T, F41N+K43S/T, W42N+ Q44S/T, K43N+Y45T; Q44N+V46S/T, Y45N+D47T, V46N+G48S/T, D47N+D49S/T, G48N+Q50S/T, D49N+ C51S/T, Q50N+E52S/T, E52N+N54T, S53N+P55S/T, C56S/T, L57N+G59S/T, G59N+S61T; G60S/T, S61N+ K63S/T, K63N+D65S/T, D65N+N67S/T, I66N+S68S/T, Y69S/T, Y69N+C71S/T, S68N+E70S/T, E70N+W72S/T, W72N+P74S/T, P74N+G76S/T, F75N, G76N+E78T, E78N+ K80T, F77T, F77N+G79S/T, G79N+N81S/T, K80N+C82S/ T, E83S/T, E83N+D85S/T, L84N+V86S/T, D85N, V86A, V86N+C88S/T, T87N+N89S/T, I90N+N92S/T, K91S/T, I90N+N92S/T, K91N+G93S/T, R94S/T, R94N+E96S/T, K100N, A103S/T, S102N+D104S/T, A103N+N105S/T, D104N+K106S/T, V107S/T, K106N+V108S/T, V108N+ V110S/T, S111N, E113N+Y115S/T, G114N+R116S/T, R116N+A118S/T, E119N+Q121S/T, K122S/T, Q121N+ S123S/T, K122N+C124S/T S123N+E125S/T, E125N+ A125S/T, P126N+V128S/T, A127N+P129T, V128N+ F130S/T, P129N+P131S/T, F130N+C132S/T, R134N, V135N+V137S/T, S136N, S138N, V137N+Q139T; Q139N, T140N+L142S/T, S141N+L143S/T, K142N, A146N+ A148S/T, E147N+V149S/T, T148N+F150S/T, V149N+ P151S/T, F150N+D152S/T, P151N+V153S/T, D152N+ D154S/T, V153N+Y155S/T, D154N+V156S/T, Y155N+ N157S/T, V156N, S158N+E160S/T, T159N+A161S/T, E160N+E162S/T, A161N, E162N+I164S/T, T163N+L165S/ T, I164N+D166S/T, L165N+N167S/T, D166N+I168S/T, I168N+Q170S/T, T169N, Q170N, S171N+Q173S/T, T172N, Q173N+F175S/T, S174N+N176S/T, F175N+ D177S/T, F178S/T, D177N, D177E, F178N+R180S/T, T179N+V181S/T, R180N+V182S/T, G183+E185S/T, G184N+D186T, E185N+A187S/T, D186N+K188S/T, A187N+P189T, K188N+G190S/T, P189N+Q181S/T, G200N+V202T, K201N+D203S/T, K201T, V202N+A204S/ T, D203N+F205S/T, E213N+W215S/T, K214T, V223T, E224N+G226S/T, T225N+V227S/T, G226N+K228S/T, V227N+I229T, K228N, H236N+I238T; I238N+E240T; E239N, E240N+E242S/T, E242N, T241N+H243S/T, H243N+E245S/T, K247N+N249S/T, V250N+R252T, I251 S/T, I251N+I253S/T, R252N+I254S/T, I253N+P255S/T, P255N+H257S/T, H257N+Y259S/T, N260S/T, A262S/T, A261N+I263S/T, A262N+N264S/T, I263N+K265S/T, K265N+N267S/T, A266N+H268S/T, D276N+P278S/T, P278N+V280S/T, E277N+L279S/T, V280N+N282S/T, Y284S/T, S283N+V285S/T, Y284N, D292N+K294S/T, K293N+Y295S/T, E294N, F299S/T, I298N+L300S/T, K301N+G303S/T, F302N, G303N+G305S/T, S304N+ Y306S/T, Y306N+S308S/T, R312N+F314S/T, V313N+ H315T, F314N+K316S/T, H315N+G317S/T, K316N+ R138S/T, G317N, R318N+A320S/T, S319N+L321S/T, A320N+V322T, L321N+L323S/T, V322N+Q324S/T, Y325N+R327S/T, R327N+P329S/T, P329N+V331S/T, L330N+D332S/T, D332N+A334S/T, R333N, A334N+ C336S/T, T335N+L337S/T, L337N, R338N, S339N+ K341T, T340N+F342T; K341N, F342N+I344S/T, T343N+ Y345S/T, Y345N+N347S/T, M348S/T, G352N+H354T, F353N, F353N+E355T, H354N+G356S/T, H354V, H354I, E355T, E355N+G357S/T, G356N+R358T, G357N+D359S/ T, R358N, Q362N+D364S/T, V370N; T371V; T371I; E372T, E372N+E374S/T, E374N, G375N, W385N+E387T;

G386N+E388T, E388N+A390S/T, A390N+K392T, M391N+G393S/T, K392N+K394S/T, K392V, G393T, G393N+Y395S/T, K394N+G396S/T, R403N+V405S/T, I408S/T, K409N+K411S/T, E410N, K411N+K413S/T, and K413N.

e. Modifications to Increase Resistance to Proteases

Modified FIX polypeptides provided herein also can contain additional modifications that result in increased resistance of the polypeptide to proteases. For example, amino acid substitutions can be made that remove one or more potential proteolytic cleavage sites. The modified FIX polypeptides can thus be made more resistant to proteases, thereby increasing the stability and half-life of the modified polypeptide.

Examples of additional modifications that can be included in the modified FIX polypeptides provided herein to increase resistance to proteases include, but are not limited to, those described in U.S. Patent Publication No. 20080102115 and International Published Application No. WO2007149406. Exemplary modifications that can be included in a modified FIX polypeptide provided herein to increase protease resistance include, but are not limited to, Y1H, Y1I, S3Q, S3H, S3N, G4Q, G4H, G4N, K5N, K5Q, L6I, L6V, E7Q, E7H, E7N, E8Q, E8H, E8N, F9I, F9V, V10Q, V10H, V10N, G12Q, G12H, G12N, L14I, L14V, E15Q, E15H, E15N, R16H, R16Q, E17Q, E17H, E17N, M19I, M19V, E20Q, E20H, E20N, E21Q, E21H, E21N, K22N, K22Q, S24Q, S24H, S24N, F25I, F25V, E26Q, E26H, E26N, E27Q, E27H, E27N, A28Q, A28H, A28N, R29H, R29Q, E30Q, E30H, E30N, V31Q, V31H, V31N, F32I, F32V, E33Q, E33H, E33N, T35Q, T35H, T35N, E36Q, E36H, E36N, R37H, R37Q, T38Q, T38H, T38N, T39Q, T39H, T39N, E40Q, E40H, E40N, F41I, F41V, W42S, W42H, K43N, K43Q, Y45H, Y45I, V46Q, V46H, V46N, D47N, D47Q, G48Q, G48H, G48N, D49N, D49Q, E52Q, E52H, E52N, S53Q, S53H, S53N, P55A, P55S, L57I, L57V, N58Q, N58S, G59Q, G59H, G59N, G60Q, G60H, G60N, S61Q, S61H, S61N, K63N, K63Q, D64N, D64Q, D65N, D65Q, I66Q, I66H, I66N, S68Q, S68H, S68N, Y69H, Y69I, E70Q, E70H, E70N, W72S, W72H, P74A, P74S, F75I, F75V, G76Q, G76H, G76N, F77I, F77V, E78Q, E78H, E78N, G79Q, G79H, G79N, K80N, K80Q, E83Q, E83H, E83N, L84I, L84V, D85N, D85Q, V86Q, V86H, V86N, T87Q, T87H, T87N, I90Q, I90H, I90N, K91N, K91Q, N92Q, N92S, G93Q, G93H, G93N, R94H, R94Q, E96Q, E96H, E96N, F98I, F98V, K100N, K100Q, S102Q, S102H, S102N, A103Q, A103H, A103N, D104N, D104Q, K106N, K106Q, V107Q, V107H, V107N, V108Q, V108H, V108N, S110Q, S110H, S110N, T112Q, T112H, T112N, E113Q, E113H, E113N, G114Q, G114H, G114N, Y115H, Y115I, R116H, R116Q, L117I, L117V, A118Q, A118H, A118N, E119Q, E119H, E119N, K122N, K122Q, S123Q, S123H, S123N, E125Q, E125H, E125N, P126A, P126S, A127Q, A127H, A127N, V128Q, V128H, V128N, P129A, P129S, P131A, P131S, G133Q, G133H, G133N, R134H, R134Q, V135Q, V135H, V135N, S136Q, S136H, S136N, V137Q, V137H, V137N, S138Q, S138H, S138N, T140Q, T140H, T140N, S141Q, S141H, S141N, K142N, K142Q, L143I, L143V, T144Q, T144H, T144N, R145H, R145Q, A146Q, A146H, A146N, E147Q, E147H, E147N, T148Q, T148H, T148N, V149Q, V149H, V149N, P151A, P151S, D152N, D152Q, V153Q, V153H, V153N, D154N, D154Q, Y155H, Y155I, V156Q, V156H, V156N, S158Q, S158H, S158N, T159Q, T159H, T159N, E160Q, E160H, E160N, A161Q, A161H, A161N, E162Q, E162H, E162N, T163Q, T163H, T163N, I164Q, I164H, I164N, L165I, L165V, L165Q, L165H, D166N, D166Q, I168Q, I168H, I168N, T169Q, T169H, T169N, S171Q, S171H, S171N, T172Q, T172H, T172N, S174Q, S174H, S174N, F175I, F175V, F175H, D177N, D177Q, F178I, F178V, F178H, T179Q, T179H, T179N, R180H, R180Q, V181Q, V181H, V181N, V182Q, V182H, V182N, G183Q, G183H, G183N, G184Q, G184H, G184N, E185Q, E185H, E185N, D186N, D186Q, A187Q, A187H, A187N, K188N, K188Q, P189A, P189S, G190Q, G190H, G190N, F192I, F192V, F192IH, P193A, P193S, W194S, W194H, W194I, V196Q, V196H, V196N, V197Q, V197H, V197N, L198I, L198V, L198Q, L198H, N199Q, N199S, G200Q, G200H, G200N, K201N, K201Q, V202Q, V202H, V202N, D203Q, D203N, A204Q, A204H, A204N, F205I, F205V, G207Q, G207H, G207N, G208Q, G208H, G208N, S209Q, S209H, S209N, I210Q, I210H, I210N, V211Q, V211H, V211N, E213Q, E213H, E213N, K214N, K214Q, W215S, W215H, I216Q, I216H, I216N, V217Q, V217H, V217N, T218Q, T218H, T218N, A219Q, A219H, A219N, A220Q, A220H, A220N, V223Q, V223H, V223N, E224Q, E224H, E224N, T225Q, T225H, T225N, G226Q, G226H, G226N, V227Q, V227H, V227N, K228N, K228Q, I229Q, I229H, I229N, T230Q, T230H, T230N, V231Q, V231H, V231N, V232Q, V232H, V232N, A233Q, A233H, A233N, G234Q, G234H, G234N, E235Q, E235H, E235N, I238Q, I238H, I238N, E239Q, E239H, E239N, E240Q, E240H, E240N, T241Q, T241H, T241N, E242Q, E242H, E242N, T244Q, T244H, T244N, E245Q, E245H, E245N, K247N, K247Q, R248H, R248N, V250Q, V250H, V250N, I251Q, I251H, I251N, R252H, R252Q, I253Q, I253H, I253N, I254Q, I254H, I254N, P255A, P255S, Y259H, Y259I, A261Q, A261H, A261N, A262Q, A262H, A262N, I263Q, I263H, I263N, K265N, K265Q, Y266H, Y266I, D269N, D269Q, I270Q, I270H, I270N, A271Q, A271H, A271N, L272I, L272V, L273I, L273V, E274Q, E274H, E274N, L275I, L275V, D276N, D276Q, E277Q, E277H, E277N, P278A, P278S, L279I, L279V, V280Q, V280H, V280N, L281I, L281V, S283Q, S283H, S283N, Y284H, Y284I, V285Q, V285H, V285N, T286Q, T286H, T286N, P287A, P287S, I288Q, I288H, I288N, I290Q, I290H, I290N, A291Q, A291H, A291N, D292N, D292Q, K293N, K293Q, E294Q, E294H, E294N, Y295H, Y295I, T296Q, T296H, T296N, I298Q, I298H, I298N, F299I, F299V, L300I, L300V, K301N, K301Q, F302I, F302V, G303Q, G303H, G303N, S304Q, S304H, S304N, G305Q, G305H, G305N, Y306H, Y306I, V307Q, V307H, V307N, S308Q, S308H, S308N, G309Q, G309H, G309N, W310S, W310H, G311Q, G311H, G311N, R312H, R312Q, V313Q, V313H, V313N, F314I, F314V, K316N, K316Q, G317Q, G317H, G317N, R318H, R318Q, S319Q, S319H, S319N, A320Q, A320H, A320N, L321I, L321V, V322Q, V322H, V322N, L323I, L323V, Y325H, Y325I, L326I, L326V, R327H, R327Q, V328Q, V328H, V328N, P329A, P329S, L330I, L330V, V331Q, V331H, V331N, D332N, D332Q, R333H, R333Q, A334Q, A334H, A334N, T335Q, T335H, T335N, L337I, L337V, R338H, R338Q, S339Q, S339H, S339N, T340Q, T340H, T340N, K341N, K341Q, F342I, F342V, T343Q, T343H, T343N, I344Q, I344H, I344N, Y345H, Y345I, M348I, M348V, F349I, F349V, A351Q, A351H, A351N, G352Q, G352H, G352N, F353I, F353V, E355Q, E355H, E355N, G356Q, G356H, G356N, G357Q, G357H, G357N, R358H, R358Q, D359N, D359Q, S360Q, S360H, S360N, G363Q, G363H, G363N, D364N, D364Q, S365Q, S365H, S365N, G366Q, G366H, G366N, G367Q, G367H, G367N, P368A, P368S, V370Q, V370H, V370N, T371Q, T371H, T371N, E372Q, E372H, E372N, V373Q, V373H, V373N, E374Q, E374H, E374N, G375Q, G375H, G375N, T376Q, T376H, T376N, S377Q, S377H, S377N, F378I, F378V, L379I, L379V, T380Q, T380H, T380N, G381Q, G381H, G381N, I382Q, I382H, I382N, I383Q, I383H, I383N, S384Q, S384H, S384N, W385S, W385H, G386Q, G386H, G386N, E387Q, E387H, E387N, E388Q, E388H, E388N, A390Q, A390H, A390N, M391I, M391V, K392N, K392Q, G393Q, G393H, G393N, K394N, K394Q, Y395H, Y395I, G396Q, G396H, G396N, I397Q, I397H, I397N, Y398H, Y398I, T399Q, T399H, T399N, K400N, K400Q, V401Q, V401H, V401N, S402Q, S402H, S402N, R403H, R403Q, Y404H, Y404I, V405Q, V405H, V405N, W407S, W407H, I408Q, I408H, I408N, K409N, K409Q, E410Q, E410H, E410N, K411N, K411Q, T412Q, T412H, T412N, K413N, K413Q, L414I, L414V, T415Q, T415H, and T415N (numbering corresponding to a mature FIX polypeptide set forth in SEQ ID NO:3).

f. Modifications to Reduce Immunogenicity

Further modifications to a modified FIX polypeptide provided herein can include modifications of at least one amino acid residue resulting in a substantial reduction in activity of or elimination of one or more T cell epitopes from the protein, i.e. deimmunization of the polypeptide. One or more amino acid modifications at particular positions within any of the MHC class II ligands can result in a deimmunized FIX polypeptide with reduced immunogenicity when administered as a therapeutic to a subject, such as for example, a human subject. For example, any one or more modifications disclosed in U.S. Patent Publication No. 20040254106 can be included in the modified FIX polypeptide provided herein to reduce immunogenicity.

Exemplary amino acid modifications that can contribute to reduced immunogenicity of a FIX polypeptide include any one or more amino acid modifications corresponding to any one or more of the following modifications: Y1A, Y1C, Y1D, Y1E, Y1G, Y1H, Y1K, Y1N, Y1P, Y1Q, Y1R, Y1S, Y1T, S3T, L6A, L6C, L6D, L6E, L6G, L6H, L6K, L6N, L6P, L6Q, L6R, L6S, L6T, L6M, F9A, F9C, F9D, F9E, F9G, F9H, F9K, F9N, F9P, F9Q, F9R, F9S, F9T, F9I, F9M, F9W, V10A, V10C, V10D, V10E, V10G, V10H, V10K, V10N, V10P, V10Q, V10R, V10S, V10T, V10F, V10I, V10M, V10W, V10Y, Q11A, Q11C, Q11G, Q11P, G12D, G12E, G12G, G12H, G12K, G12N, G12P, G12Q, G12R, G12S, G12T, N13A, N13C, N13G, N13H, N13P, N13T, L14A, L14C, L14D, L14E, L14G, L14H, L14K, L14N, L14P, L14Q, L14R, L14S, L14T, L14F, L14I, L14M, L14V, L14W, L14Y, E15D, E15H, E15P, R16A, R16C, R16G, R16P, R16T, E17A, E17C, E17G, E17P, E17T, C18D, C18E, C18G, C18H, C18K, C18N, C18P, C18Q, C18R, C18S, C18T, M19A, M19C, M19D, M19E, M19G, M19H, M19K, M19N, M19P, M19Q, M19R, M19S, M19T, M19F, M19I, M19M, M19V, M19W, M19Y, E20A, E20C, E20G, E20P, E20T, E21A, E21C, E21G, E21P, K22H, K22P, K22T, S24H, S24P, F25A, F25C, F25D, F25E, F25G, F25H, F25K, F25N, F25P, F25Q, F25R, F25S, F25T, F25I, F25M, F25W, F25Y, E26A, E26C, E26G, E26P, E27A, E27C, E27G, E27H, E27P, E27S, E27T, A28C, A28D, A28E, A28G, A28H, A28K, A28N, A28P, A28Q, A28R, A28S, A28T, R29A, R29C, R29G, R29P, E30D, E30H, E30P, V31A, V31C, V31D, V31E, V31G, V31H, V31K, V31N, V31P, V31Q, V31R, V31S, V31T, V31F, V31I, V31W, V31Y, F32A, F32C, F32D, F32E, F32G, F32H, F32K, F32N, F32P, F32Q, F32R, F32S, F32T, E33H, E33N, E33P, E33Q, E33S, E33T, T35A, T35C, T35G, T35P, F41A, F41C, F41D, F41E, F41G, F41H, F41K, F41N, F41P, F41Q, F41R, F41S, F41T, F41M, F41W, F41Y, W42A, W42C, W42D, W42E, W42G, W42H, W42K, W42N, W42P, W42Q, W42R, W42S, W42T, K43A, K43C, K43G, K43P, Q44P, Q44T, Q44, Y45A, Y45C, Y45D, Y45E, Y45G, Y45H, Y45K, Y45N, Y45P, Y45Q, Y45R, Y45S, Y45T, V46A, V46C, V46D, V46E, V46G, V46H, V46K, V46N, V46P, V46Q, V46R, V46S, V46T, V46F, V46I, V46M, V46W, V46Y, D47A, D47C, D47G, D47H, D47P, D47T, G48D, G48E, G48P, G48T, D49H, D49P, D49Q, D49T, Q50A, Q50C, Q50D, Q50G, Q50H, Q50P, Q50T, C51D, C51E, C51G, C51H, C51K, C51N, C51P, C51Q, C51R, C51S, C51T, E52P, E52T, S53A, S53C, S53H, S53P, S53T, N54H, N54P, N54T, L57A, L57C, L57D, L57E, L57G, L57H, L57K, L57N, L57P, L57Q, L57R, L57S, L57T, L57F, L57I, L57M, L57W, L57Y, G60C, G60D, G60H, G60P, G60T, C62D, C62H, C62P, K63T, D65H, D65P, I66A, I66C, I66D, I66E, I66G, I66H, I66K, I66N, I66P, I66Q, I66R, I66S, I66T, I66M, I66W, I66Y, Y69A, Y69C, Y69D, Y69E, Y69G, Y69H, Y69K, Y69N, Y69P, Y69Q, Y69R, Y69S, Y69T, C71H, C71P, W72A, W72C, W72D, W72E, W72G, W72H, W72K, W72N, W72P, W72Q, W72R, W72S, W72T, W72I, W72Y, F75A, F75C, F75D, F75E, F75G, F75H, F75K, F75N, F75P, F75Q, F75R, F75S, F75T, F77A, F77C, F77D, F77E, F77G, F77H, F77K, F77N, F77P, F77Q, F77R, F77S, F77T, L84A, L84C, L84D, L84E, L84G, L84H, L84K, L84N, L84P, L84Q, L84R, L84S, L84T, L84M, L84W, L84Y, V86A, V86C, V86D, V86E, V86G, V86H, V86K, V86N, V86P, V86Q, V86R, V86S, V86T, I90A, I90C, I90D, I90E, I90G, I90H, I90K, I90N, I90P, I90Q, I90R, I90S, I90T, I90M, I90W, K91A, K91C, K91G, K91P, N92A, N92C, N92G, N92P, N92T, G93D, G93E, G93H, G93K, G93N, G93P, G93Q, G93R, G93S, G93T, R94A, R94C, R94G, R94P, C95D, C95E, C95G, C95H, C95K, C95N, C95P, C95Q, C95R, C95S, C95T, E96P, E96T, Q97A, Q97C, Q97G, Q97P, F98A, F98C, F98D, F98E, F98G, F98H, F98K, F98N, F98P, F98Q, F98R, F98S, F98T, F98M, F98W, F98Y, K100A, K100C, K100G, K100P, N101H, N101T, A103D, A103E, A103H, A103K, A103N, A103P, A103Q, A103R, A103S, A103T, D104T, K106H, K106P, K106T, V107A, V107C, V107D, V107E, V107G, V107H, V107K, V107N, V107P, V107Q, V107R, V107S, V107T, V108A, V108C, V108D, V108E, V108G, V108H, V108K, V108N, V108P, V108Q, V108R, V108S, V108T, V108F, V108M, V108W, V108Y, S110A, S110C, S110G, S110P, C111D, C111E, C111H, C111K, C111N, C111P, C111Q, C111R, C111S, C111T, T112A, T112C, T112G, T112P, E113D, E113H, E113P, G114D, G114E, G114H, G114K, G114N, G114Q, G114R, G114S, G114T, Y115A, Y115C, Y115D, Y115E, Y115G, Y115H, Y115K, Y115N, Y115P, Y115Q, Y115R, Y115S, Y115T, Y115M, Y115W, R116P, R116T, L117A, L117C, L117D, L117E, L117G, L117H, L117K, L117N, L117P, L117Q, L117R, L117S, L117T, A118D, A118E, A118H, A118K, A118N, A118P, A118Q, A118R, A118S, A118T, N120D, N120H, N120P, Q121T, S123H, S123T, V128A, V128C, V128D, V128E, V128G, V128H, V128K, V128N, V128P, V128Q, V128R, V128S, V128T, F130A, F130C, F130D, F130E, F130G, F130H, F130K, F130N, F130P, F130Q, F130R, F130S, F130T, V135A, V135C, V135D, V135E, V135G, V135H, V135K, V135N, V135P, V135Q, V135R, V135S, V135T, V135W, V135Y, V137A, V137C, V137D, V137E, V137G, V137H, V137K, V137N, V137P, V137Q, V137R, V137S, V137T, V137M, V137W, V137Y, S138H, S138T, T140D, T140H, S141T, K142H, K142P, L143A, L143C, L143D, L143E, L143G, L143H, L143K, L143N, L143P, L143Q, L143R, L143S, L143T, L143F, L143I, L143M, L143V, L143W, L143Y, R145H, R145P, R145T, A146P, A146T, T148H, T148P, V149A, V149C, V149D, V149E, V149G, V149H, V149K, V149N, V149P, V149Q, V149R, V149S, V149T, V149F, V149I, V149M, V149W, V149Y, F150A, F150C, F150D, F150E, F150G, F150H, F150K, F150N, F150P, F150Q, F150R, F150S, F150T, F150M, F150W, F150Y, D152A, D152C, D152G, D152P, D152S, D152T, V153A, V153C, V153D, V153E, V153G, V153H, V153K, V153N, V153P, V153Q, V153R, V153S, V153T, V153F, V153I, V153M, V153W, V153Y, D154A, D154C, D154G, D154P, D154Q, D154S, Y155A, Y155C, Y155D, Y155E, Y155G, Y155H, Y155K, Y155N, Y155P, Y155Q, Y155R, Y155S, Y155T, Y155M, Y155V, Y155W, V156A, V156C, V156D, V156E, V156G, V156H, V156K, V156N, V156P, V156Q, V156R, V156S, V156T, V156I, V156M, V156W, V156Y, N157A, N157C, N157G, N157H, N157P, N157Q, N157T, S158H, S158P, S158T, T159A, T159C, T159G, T159P, E160A, E160C, E160G, E160P, A161C, A161E, A161H, A161K, A161N, A161P, A161Q, A161R, A161S, A161T, E162P, E162T, T163A, T163C, T163G, T163P, I164A, I164C, I164D, I164E, I164G, I164H, I164K, I164N, I164P, I164Q, I164R, I164S, I164T, L165A, L165C, L165D, L165E, L165G, L165H, L165K, L165N, L165P, L165Q, L165R, L165S, L165T, L165M, L165W, L165Y, I168A, I168C, I168D, I168E, I168G, I168H, I168K, I168N, I168P, I168Q, I168R, I168S, I168T, F175A, F175C, F175D, F175E, F175G, F175H, F175K, F175N, F175P, F175Q, F175R, F175S, F175T, F178A, F178C, F178D, F178E, F178G, F178H, F178K, F178N, F178P, F178Q, F178R, F178S, F178T, F178M, F178W, F178Y, T179A, T179C, T179G, T179P, R180A, R180C, R180D, R180G, R180H, R180P, V181A, V181C, V181D, V181E, V181G, V181H, V181K, V181N, V181P, V181Q, V181R, V181S, V181T, V181F, V181I, V181M, V181W, V181Y, V182A, V182C, V182D, V182E, V182G, V182H, V182K, V182N, V182P, V182Q, V182R, V182S, V182T, V182F, V182I, V182M, V182W, V182Y, G183D, G183E, G183H, G183K, G183N, G183P, G183Q, G183S, G183T, G184D, G184E, G184H, G184K, G184N, G184P, G184Q, G184R, G184S, G184T, E185A, E185C, E185G, E185H, E185P, E185T, D186A, D186C, D186G, D186H, D186P, D186T, A187C, A187D, A187G, A187H, A187K, A187N, A187P, A187Q, A187R, A187S, A187T, K188A, K188C, K188G, K188H, K188P, K188T, G190D, G190E, G190H, G190K, G190N, G190P, G190Q, G190R, G190S, G190T, F192A, F192C, F192D, F192E, F192G, F192H, F192K, F192N, F192P, F192Q, F192R, F192S, F192T, F192W, F192Y, W194A, W194C, W194D, W194E, W194G, W194H, W194K, W194N, W194P, W194Q, W194R, W194S, W194T, Q195H, Q195P, Q195T, V196A, V196C, V196D, V196E, V196G, V196H, V196K, V196N, V196P, V196Q, V196R, V196S, V196T, V196F, V196I, V196M, V196W, V196Y, V197A, V197C, V197D, V197E, V197G, V197H, V197K, V197N, V197P, V197Q, V197R, V197S, V197T, V197F, V197I, V197M, V197W, V197Y, L198A, L198C, L198D, L198E, L198G, L198H, L198K, L198N, L198P, L198Q, L198R, L198S, L198T, L198I, L198Y, N199A, N199C, N199G, N199H, N199P, N199S, N199T, G200P, G200T, K201A, K201C, K201D, K201E, K201G, K201H, K201N, K201P, K201Q, K201S, K201T, V202A, V202C, V202D, V202E, V202G, V202H, V202K, V202N, V202P, V202Q, V202R, V202S, V202T, V202F, V202I, V202M, V202W, V202Y, D203A, D203C, D203G, D203P, D203T, A204C, A204D, A204E, A204G, A204H, A204K, A204N, A204P, A204Q, A204R, A204S, A204T, F205A, F205C, F205D, F205E, F205G, F205H, F205K, F205N, F205P, F205Q, F205R, F205S, F205T, F205M, F205V, F205W, F205Y, G207H, G207P, G208C, G208D, G208E, G208H, G208K, G208N, G208P, G208Q, G208R, G208S, G208T, S209A, S209C, S209G, S209P, I210A, I210C, I210D, I210E, I210G, I210H, I210K, I210N, I210P, I210Q, I210R, I210S, I210T, I210F, I210W, I210Y, V211A, V211C, V211D, V211E, V211G, V211H, V211K, V211N, V211P, V211Q, V211R, V211S, V211T, V211F, V211I, V211M, V211W, N212A, N212C, N212G, N212P, E213H, E213P, E213S, E213T, K214T, W215A, W215C, W215D, W215E, W215G, W215H, W215K, W215N, W215P, W215Q, W215R, W215S, W215T, I216A, I216C, I216D, I216E, I216G, I216H, I216K, I216N, I216P, I216Q, I216R, I216S, I216T, V217A, V217C, V217D, V217E, V217G, V217H, V217K, V217N, V217P, V217Q, V217R, V217S, V217T, V217I, V217Y, A219H, A219P, A219T, V223A, V223C, V223D, V223E, V223G, V223H, V223K, V223N, V223P, V223Q, V223R, V223S, V223T, V223M, V223W, V223Y, G226P, V227A, V227C, V227D, V227E, V227G, V227H, V227K, V227N, V227P, V227Q, V227R, V227S, V227T, V227F, V227I, V227M, V227W, V227Y, K228A, K228C, K228G, K228H, K228P, I229A, I229C, I229D, I229E, I229G, I229H, I229K, I229N, I229P, I229Q, I229R, I229S, I229T, I229M, I229W, I229Y, T230A, T230C, T230G, T230P, V231A, V231C, V231D, V231E, V231G, V231H, V231K, V231N, V231P, V231Q, V231R, V231S, V231T, V232A, V232C, V232D, V232E, V232G, V232H, V232K, V232N, V232P, V232Q, V232R, V232S, V232T, V232F, V232I, V232M, V232W, V232Y, A233C, A233D, A233E, A233G, A233H, A233K, A233N, A233P, A233Q, A233R, A233S, A233T, A233V, G234D, G234E, G234H, G234K, G234N, G234P, G234Q, G234R, G234S, G234T, E235H, E235N, E235P, E235Q, E235S, E235T, H236A, H236C, H236G, H236P, N237A, N237C, N237G, N237P, N237T, I238A, I238C, I238D, I238E, I238G, I238H, I238K, I238N, I238P, I238Q, I238R, I238S, I238T, E239A, E239C, E239G, E239P, E240H, E240T, V250A, V250C, V250D, V250E, V250G, V250H, V250K, V250N, V250P, V250Q, V250R, V250S, V250T, V250M, V250W, V250Y, I251A, I251C, I251D, I251E, I251G, I251H, I251K, I251N, I251P, I251Q, I251R, I251S, I251T, I253A, I253C, I253D, I253E, I253G, I253H, I253K, I253N, I253P, I253Q, I253R, I253S, I253T, I253M, I253W, I253Y, I254A, I254C, I254D, I254E, I254G, I254H, I254K, I254N, I254P, I254Q, I254R, I254S, I254T, P255H, H256P, H256T, H257C, H257G, H257P, N258P, N258T, Y259A, Y259C, Y259D, Y259E, Y259G, Y259H, Y259K, Y259N, Y259P, Y259Q, Y259R, Y259S, Y259T, Y259M, Y259W, N260A, N260C, N260G, N260P, A261D, A261E, A261H, A261K, A261N, A261P, A261Q, A261R, A261S, A261T, A262C, A262D, A262E, A262G, A262H, A262K, A262N, A262P, A262Q, A262R, A262S, A262T, I263A, I263C, I263D, I263E, I263G, I263H, I263K, I263N, I263P, I263Q, I263R, I263S, I263T, I263M, I263V, I263W, I263Y, N264A, N264C, N264D, N264G, N264H, N264P, K265A, K265C, K265G, K265H, K265P, Y266A, Y266C, Y266D, Y266E, Y266G, Y266H, Y266K, Y266N, Y266P, Y266Q, Y266R, Y266S, Y266T, Y266M, Y266W, N267A, N267C, N267G, N267H, N267P, N267T, H268P, D269A, D269C, D269E, D269G, D269H, D269N, D269P, D269Q, D269S, D269T, I270A, I270C, I270D, I270E, I270G, I270H, I270K, I270N, I270P, I270Q, I270R, I270S, I270T, I270M, I270W, A271C, A271D, A271E, A271G, A271H, A271K, A271N, A271P, A271Q, A271R, A271S, A271T, L272A, L272C, L272D, L272E, L272G, L272H, L272K, L272N, L272P, L272Q, L272R, L272S, L272T, L272F, L273A, L273C, L273D, L273E, L273G, L273H, L273K, L273N, L273P, L273Q, L273R, L273S, L273T, L273F, L273I, L273M, L273V, L273W, L273Y, E274A, E274C, E274G, E274P, E274T, L275A, L275C, L275D, L275E, L275G, L275H, L275K, L275N, L275P, L275Q, L275R, L275S, L275T, L275W, L275Y, D276P, D276S, D276T, E277A, E277C, E277G, E277P, P278T, L279A, L279C, L279D, L279E, L279G, L279H, L279K, L279N, L279P, L279Q, L279R, L279S, L279T, L279I, L279Y, V280A, V280C, V280D, V280E, V280G, V280H, V280K, V280N, V280P, V280Q, V280R, V280S, V280T, V280F, V280I, V280W, V280Y, L281A, L281C, L281D, L281E, L281G, L281H, L281K, L281N, L281P, L281Q, L281R, L281S, L281T, L281F, L281I, L281V, L281W, L281Y, S283A, S283C, S283G, S283P, Y284A, Y284C, Y284D, Y284E, Y284G, Y284H, Y284K, Y284N, Y284P, Y284Q, Y284R, Y284S, Y284T, Y284M, V285A, V285C, V285D, V285E, V285G, V285H, V285K, V285N, V285P, V285Q, V285R, V285S, V285T, V285M, V285W, V285Y, T286A, T286C, T286G, T286P, I288A, I288C, I288D, I288E, I288G, I288H, I288K, I288N, I288P, I288Q, I288R, I288S, I288T, C289D, C289H, C289P, I290A, I290C, I290D, I290E, I290G, I290H, I290K, I290N, I290P, I290Q, I290R, I290S, I290T, I290Y, A291D, A291E, A291H, A291K, A291N, A291P, A291Q, A291R, A291S, A291T, D292A, D292C, D292G, D292P, D292T, K293H, K293P, K293T, Y295A, Y295C, Y295D, Y295E, Y295G, Y295H, Y295K, Y295N, Y295P, Y295Q, Y295R, Y295S, Y295T, Y295W, T296A, T296C, T296G, T296P, N297A, N297C, N297G, N297P, I298A, I298C, I298D, I298E, I298G, I298H, I298K, I298N, I298P, I298Q, I298R, I298S, I298T, F299A, F299C, F299D, F299E, F299G, F299H, F299K, F299N, F299P, F299Q, F299R, F299S, F299T, L300A, L300C, L300D, L300E, L300G, L300H, L300K, L300N, L300P, L300Q, L300R, L300S, L300T, L300F, L300I, L300M, L300V, L300W, L300Y, K301A, K301C, K301G, K301P, K301T, F302A, F302C, F302D, F302E, F302G, F302H, F302K, F302N, F302P, F302Q, F302R, F302S, F302T, G303H, G303P, G303T, S304A, S304C, S304G, S304P, S304T, G305D, G305E, G305H, G305N, G305P, G305Q, G305S, G305T, Y306A, Y306C, Y306D, Y306E, Y306G, Y306H, Y306K, Y306N, Y306P, Y306Q, Y306R, Y306S, Y306T, Y307A, Y307C, Y307D, Y307E, Y307G, Y307H, Y307K, Y307N, Y307P, Y307Q, Y307R, Y307S, Y307T, S308P, S308T, W310A, W310C, W310D, W310E, W310G, W310H, W310K, W310N, W310P, W310Q, W310R, W310S, W310T, G311H, V313A, V313C, V313D, V313E, V313G, V313H, V313K, V313N, V313P, V313Q, V313R, V313S, V313T, F314A, F314C, F314D, F314E, F314G, F314H, F314K, F314N, F314P, F314Q, F314R, F314S, F314T, F314M, F314W, F314Y, H315A, H315C, H315G, H315P, K316A, K316C, K316G, K316P, G317C, G317D, G317E, G317H, G317K, G317N, G317P, G317Q, G317R, G317S, G317T, R318A, R318C, R318G, R318P, S319D, S319H, S319N, S319P, S319Q, A320C, A320D, A320E, A320G, A320H, A320K, A320N, A320P, A320Q, A320R, A320S, A320T, L321A, L321C, L321D, L321E, L321G, L321H, L321K, L321N, L321P, L321Q, L321R, L321S, L321T, V322A, V322C, V322D, V322E, V322G, V322H, V322K, V322N, V322P, V322Q, V322R, V322S, V322T, V322W, V322Y, L323A, L323C, L323D, L323E, L323G, L323H, L323K, L323N, L323P, L323Q, L323R, L323S, L323T, L323F, L323I, L323M, L323V, L323W, L323Y, Q324A, Q324C, Q324G, Q324P, Y325A, Y325C, Y325D, Y325E, Y325G, Y325H, Y325K, Y325N, Y325P, Y325Q, Y325R, Y325S, Y325T, Y325W, L326A, L326C, L326D, L326E, L326G, L326H, L326K, L326N, L326P, L326Q, L326R, L326S, L326T, L326F, L326I, L326M, L326V, L326W, L326Y, R327A, R327C, R327G, R327H, R327P, V328A, V328C, V328D, V328E, V328G, V328H, V328K, V328N, V328P, V328Q, V328R, V328S, V328T, V328F, V328I, V328M, V328W, V328Y, L330A, L330C, L330D, L330E, L330G, L330H, L330K, L330N, L330P, L330Q, L330R, L330S, L330T, L330F, L330I, L330V, L330W, L330Y, V331A, V331C, V331D, V331E, V331G, V331H, V331K, V331N, V331P, V331Q, V331R, V331S, V331T, V331F, V331I, V331M, V331W, V331Y, D332A, D332C, D332G, D332P, R333A, R333C, R333D, R333E, R333G, R333H, R333N, R333P, R333Q, R333R, R333S, R333T, A334C, A334D, A334E, A334G, A334H, A334K, A334N, A334P, A334Q, A334R, A334S, A334T, T335A, T335C, T335G, T335P, C336D, C336E, C336H, C336K, C336N, C336P, C336Q, C336R, C336S, C336T, L337A, L337C, L337D, L337E, L337G, L337H, L337K, L337N, L337P, L337Q, L337R, L337S, L337T, R338A, R338C, R338G, R338P, S339P, S339T, K341A, K341C, K341G, K341P, F342A, F342C, F342D, F342E, F342G, F342H, F342K, F342N, F342P, F342Q, F342R, F342S, F342T, F342M, F342W, T343A, T343C, T343G, T343P, I344A, I344C, I344D, I344E, I344G, I344H, I344K, I344N, I344P, I344Q, I344R, I344S, I344T, Y345A, Y345C, Y345D, Y345E, Y345G, Y345H, Y345K, Y345N, Y345P, Y345Q, Y345R, Y345S, Y345T, Y345M, Y345W, N346A, N346C, N346G, N346P, N347H, N347P, M348A, M348C, M348D, M348E, M348G, M348H, M348K, M348N, M348P, M348Q, M348R, M348S, M348T, F349A, F349C, F349D, F349E, F349G, F349H, F349K, F349N, F349P, F349Q, F349R, F349S, F349T, F349I, F349M, F349W, F349Y, C350D, C350H, C350P, C350T, A351E, A351H, A351N, A351P, A351Q, A351R, A351S, A351T, G352A, G352C, G352P, F353A, F353C, F353D, F353E, F353G, F353H, F353K, F353N, F353P, F353Q, F353R, F353S, F353T, F353I, F353M, F353W, H354A, H354C, H354G, H354P, E355A, E355C, E355D, E355G, E355H, E355K, E355N, E355P, E355Q, E355S, E355T, G356D, G356E, G356H, G356K, G356N, G356P, G356Q, G356R, G356S, G356T, G357D, G357E, G357H, G357K, G357N, G357P, G357Q, G357R, G357S, G357T, R358D, R358E, R358H, R358K, R358N, R358P, R358Q, R358R, R358S, R358T, D359A, D359C, D359G, D359P, D359Q, D359S, D359T, S360A, S360C, S360G, S360P, C361D, C361E, C361H, C361K, C361N, C361P, C361Q, C361R, C361S, C361T, V370A, V370C, V370D, V370E, V370G, V370H, V370K, V370N, V370P, V370Q, V370R, V370S, V370T, V370W, V370Y, V373A, V373C, V373D, V373E, V373G, V373H, V373K, V373N, V373P, V373Q, V373R, V373S, V373T, V373F, V373I, V373M, V373W, E374A, E374C, E374G, E374P, G375H, S377A, S377C, S377G, S377P, F378A, F378C, F378D, F378E, F378G, F378H, F378K, F378N, F378P, F378Q, F378R, F378S, F378T, F378W, L379A, L379C, L379D, L379E, L379G, L379H, L379K, L379N, L379P, L379Q, L379R, L379S, L379T, L379I, L379M, L379W, L379Y, T380A, T380C, T380G, T380P, G381D, G381E, G381H, G381K, G381N, G381P, G381Q, G381R, G381S, G381T, I382A, I382C, I382D, I382E, I382G, I382H, I382K, I382N, I382P, I382Q, I382R, I382S, I382T, I382M, I382W, I382Y, I383A, I383C, I383D, I383E, I383G, I383H, I383K, I383N, I383P, I383Q, I383R, I383S, I383T, S384A, S384C, S384G, S384P, W385A, W385C, W385D, W385E, W385G, W385H, W385K, W385N, W385P, W385Q, W385R, W385S, W385T, W385M, E387A, E387C, E387G, E387H, E387P, E387T, E388H, E388N, E388P, E388Q, E388T, A390C, A390D, A390E, A390G, A390H, A390K, A390N, A390P, A390Q, A390R, A390S, M391A, M391C, M391D, M391E, M391G, M391H, M391K, M391N, M391P, M391Q, M391R, M391S, M391T, M391F, M391I, M391W, M391Y, K392A, K392C, K392G, K392P, G393C, G393D, G393E, G393H, G393K, G393N, G393P, G393Q, G393R, G393S, G393T, Y395A, Y395C, Y395D, Y395E, Y395G, Y395H, Y395K, Y395N, Y395P, Y395Q, Y395R, Y395S, Y395T, Y398A, Y398C, Y398D, Y398E, Y398G, Y398H, Y398K, Y398N, Y398P, Y398Q, Y398R, Y398S, Y398T, K400H, V401A, V401C, V401D, V401E, V401G, V401H, V401K, V401N, V401P, V401Q, V401R, V401S, V401T, V401F, V401I, V401M, V401W, V401Y, S402A, S402C, S402G, S402P, R403A, R403C, R403G, R403P, R403T, Y404A, Y404C, Y404D, Y404E, Y404G, Y404H, Y404K, Y404N, Y404P, Y404Q, Y404R, Y404S, Y404T, V405A, V405C, V405D, V405E, V405G, V405H, V405K, V405N, V405P, V405Q, V405R, V405S, V405T, V405W, V405Y, N406F, N406H, N406I, N406L, N406P, N406W, N406Y, W407D, W407E, W407F, W407H, W407I, W407K, W407N, W407P, W407Q, W407R, W407S, W407T, W407Y, I408D, I408E, I408H, I408K, I408N, I408P, I408Q, I408R, I408S, I408T, K409F, K409H, K409I, K409P, K409T, K409V, K409W, K409Y, E410H, K411A, K411C, K411 G, K411I, K411P, K411T, K411V, K411 W, K411Y or K413T, with numbering corresponding to a mature FIX polypeptide set forth in SEQ ID NO: 3.

g. Exemplary Combination Modifications

Provided herein are modified FIX polypeptides that have two or more modifications designed to affect one or more properties or activities of an unmodified FIX polypeptide. In some examples, the two or more modifications alter two or more properties or activities of the FIX polypeptide. The modifications can be made to the FIX polypeptides such that one or more of glycosylation, resistance to AT-III, resistance to AT-III/heparin, resistance to heparin, catalytic activity, binding to LRP, intrinsic activity, phospholipid binding and/ or affinity, resistance to proteases, half-life and interaction with other factors or molecules, such as FVIIIa and FX, is altered. Typically, the two or more modifications are combined such that the resulting modified FIX polypeptide has increased coagulant activity, increased duration of coagulant activity, and/or an enhanced therapeutic index compared to an unmodified FIX polypeptide. The modifications can include amino acid substitution, insertion or deletion. The increased coagulant activity, increased duration of coagulant activity, and/or an enhanced therapeutic index of the modified FIX polypeptide containing two or more modifications can be increased by at least or at least about 1%, 2%, 3%, 4%, 5%, 6%, 7%, 8%, 9%, 10%, 20%, 30%, 40%, 50%, 60%, 70%, 80%, 90%, 100%, 110%, 120%, 130%, 140%, 150%, 160%, 170%, 180%, 190%, 200%, 300%, 400%, 500%, or more compared to the activity of the starting or unmodified FIXa polypeptide.

Provided herein are modified FIX polypeptides that contain two or more modifications that are introduced into an unmodified FIX polypeptide to alter one, two or more activities or properties. The modified FIX polypeptides can contain 2, 3, 4, 5, 6 or more modifications. For example, a modified FIX polypeptide provided herein can contain the modifications to increase glycosylation by incorporating a non-native glycosylation site into the primary sequence, such as amino acid substitutions D203N and F205T to introduce a non-native glycosylation site at position 203, and a modification to increase resistance to AT-III/heparin, such as R338E (residues corresponding to a mature FIX polypeptide set forth in SEQ ID NO:3).

Modified FIX polypeptides provided herein can have two or more modifications selected solely from those set forth in Tables 3-9. In other examples, the modified FIX polypeptide contains two or more modifications where one or more modifications are selected from those set forth in Tables 3-9 and one or more modifications are additional modifications that are not set forth in Tables 3-9, such as, for example, modifications described in the art. In some examples, the one or more additional modifications can be selected from those set forth in Section D.3.a-f, above, such as those that result in increased catalytic activity, increased resistance to inhibitors, increased affinity and/or binding to platelets and phospholipids, increased protease resistance, decreased immunogenicity, and those that facilitate conjugation to moieties, such as PEG moieties.

Non-limiting exemplary combination modifications are provided in Table 10. These exemplary combination modifications include two or more modifications that are designed to alter two or more activities or properties of a FIX polypeptide, including, but not limited to, increased resistance to AT-III, increased resistance to AT-III/heparin, increased resistance to heparin, increased catalytic activity and altered glycosylation. Modified FIX polypeptides containing such combination modifications can have increased coagulant activity, increased duration of coagulant activity, and/or an enhanced therapeutic index. In Table 10 below, the sequence identifier (SEQ ID NO) is identified in which exemplary amino acid sequences of the modified FIX polypeptide are set forth.

TABLE 10

| Mutation (Mature FIX Numbering) | Mutation (Chymotrypsin Numbering) | SEQ ID NO |
|---|---|---|
| R318Y/E410N | R150Y/E240N | 153 |
| R338E/E410N | R170E/E240N | 154 |
| R338E/R403E/E410N | R170E/R233E/E240N | 155 |
| D203N/F205T/K228N | D39N/F41T/K63N | 157 |
| D203N/F205T/E410N | D39N/F41T/E240N | 158 |
| D203N/F205T/R338E | D39N/F41T/R170E | 159 |
| D203N/F205T/R338A | D39N/F41T/R170A | 160 |
| D203N/F205T/R318Y | D39N/F41T/R150Y | 161 |
| D203N/F205T/R338E/R403E | D39N/F41T/R170E/R233E | 162 |
| K228N/E410N | K63N/E240N | 163 |
| K228N/R338E | K63N/R170E | 164 |
| K228N/R338A | K63N/R170A | 165 |
| K228N/R318Y | K63N/R150Y | 166 |
| K228N/R338E/R403E | K63N/R170E/R233E | 167 |
| R403E/E410N | R233E/E240N | 168 |
| R318Y/R338E/E410N | R150Y/R170E/E240N | 169 |
| K228N/R318Y/E410N | K63N/R150Y/E240N | 170 |
| R318Y/R403E/E410N | R150Y/R233E/E240N | 171 |
| R318Y/R338E/R403E/E410N | R150Y/R170E/R233E/E240N | 172 |
| D203N/F205T/R318Y/E410N | D39N/F41T/R150Y/E240N | 173 |
| F314N/K316S | F145N/K148S | 177 |
| A103N/N105S/K228N | A[103]N/N[105]S/K63N | 217 |
| D104N/K106S/K228N | D[104]N/K[106]S/K63N | 218 |
| K228N/I251S | K63N/I86S | 180 |
| A103N/N105S/I251S | A[103]N/N[105]S/I86S | 181 |
| D104N/K106S/I251S | D[104]N/K[106]S/I86S | 182 |
| A103N/N105S/R318Y/R338E/R403E/E410N | A[103]N/N[105]S/R150Y/R170E/R233E/E240N | 219 |
| D104N/K106S/R318Y/R338E/R403E/E410N | D[104]N/K[106]S/R150Y/R170E/R233E/E240N | 220 |
| K228N/R318Y/R338E/R403E/E410N | K63N/R150Y/R170E/R233E/E240N | 221 |
| I251S/R318Y/R338E/R403E/E410N | I86S/R150Y/R170E/R233E/E240N | 222 |
| D104N/K106S/I251S/R318Y/R338E/R403E/E410N | D[104]N/K[106]S/I86S/R150Y/R170E/R233E/E240N | 223 |
| D104N/K106S/R318Y/R338E/E410N | D[104]N/K[106]S/R150Y/R170E/E240N | 224 |
| I251S/R318Y/R338E/E410N | I86S/R150Y/R170E/E240N | 225 |
| D104N/K106S/I251S/R318Y/R338E/E410N | D[104]N/K[106]S/I86S/R150Y/R170E/E240N | 226 |
| A103N/N105S/K247N/N249S | A[103]N/N[105]S/K82N/N84S | 178 |
| D104N/K106S/K247N/N249S | D[104]N/K[106]S/K82N/N84S | 179 |
| K228N/K247N/N249S | K63N/K82N/N84S | 183 |
| A103N/N105S/Y155F | A[103]N/N[105]S/Y[155]F | 227 |
| D104N/K106S/Y155F | D[104]N/K[106]S/Y[155]F | 228 |
| Y155F/K228N | Y[155]F/K63N | 229 |
| Y155F/I251S | Y[155]F/I86S | 230 |
| Y155F/K247N/N249S | Y[155]F/K82N/N84S | 231 |
| A103N/N105S/K247N/N249S/R318Y/R338E/R403E/E410N | A[103]N/N[105]S/K82N/N84S/R150Y/R170E/R233E/E240N | 232 |
| D104N/K106S/K247N/N249S/R318Y/R338E/R403E/E410N | D[104]N/K[106]S/K82N/N84S/R150Y/R170E/R233E/E240N | 233 |
| K228N/K247N/N249S/R318Y/R338E/R403E/E410N | K63N/K82N/N84S/R150Y/R170E/R233E/E240N | 234 |
| A103N/N105S/Y155F/R318Y/R338E/R403E/E410N | A[103]N/N[105]S/Y[155]F/R150Y/R170E/R233E/E240N | 235 |
| D104N/K106S/Y155F/R318Y/R338E/R403E/E410N | D[104]N/K[106]S/Y[155]F/R150Y/R170E/R233E/E240N | 236 |
| Y155F/K228N/R318Y/R338E/R403E/E410N | Y[155]F/K63N/R150Y/R170E/R233E/E240N | 237 |
| Y155F/I251S/R318Y/R338E/R403E/E410N | Y[155]F/I86S/R150Y/R170E/R233E/E240N | 238 |
| Y155F/K247N/N249S/R318Y/R338E/R403E/E410N | Y[155]F/K82N/N84S/R150Y/R170E/R233E/E240N | 239 |
| K247N/N249S/R318Y/R338E/R403E/E410N | K82N/N84S/R150Y/R170E/R233E/E240N | 240 |
| Y155F/R318Y/R338E/R403E/E410N | Y[155]F/R150Y/R170E/R233E/E240N | 241 |
| K247N/N249S/R318Y/R338E/E410N | K82N/N84S/R150Y/R170E/E240N | 242 |
| Y155F/R318Y/R338E/E410N | Y[155]F/R150Y/R170E/E240N | 243 |
| Y155F/K247N/N249S/R318Y/R338E/E410N | Y[155]F/K82N/N84S/R150Y/R170E/E240N | 244 |
| D104N/K106S/Y155F/K228N/K247N/N249S | D[104]N/K[106]S/Y[155]F/K63N/K82N/N84S | 245 |
| D104N/K106S/Y155F/K247N/N249S | D[104]N/K[106]S/Y[155]F/K82N/N84S | 246 |
| D104N/K106S/Y155F/K228N | D[104]N/K[106]S/Y[155]F/K63N | 247 |
| Y155F/K228N/K247N/N249S | Y[155]F/K63N/K82N/N84S | 248 |
| D104N/K106S/K228N/K247N/N249S | D[104]N/K[106]S/K63N/K82N/N84S | 184 |

TABLE 10-continued

| Mutation (Mature FIX Numbering) | Mutation (Chymotrypsin Numbering) | SEQ ID NO |
|---|---|---|
| R318Y/R338E/R403E/E410S | R150Y/R170E/R233E/E240S | 249 |
| R318Y/R338E/R403E/E410N/T412V | R150Y/R170E/R233E/E240N/T242V | 250 |
| R318Y/R338E/R403E/E410N/T412A | R150Y/R170E/R233E/E240N/T242A | 251 |
| R318Y/R338E/R403E/T412A | R150Y/R170E/R233E/T242A | 252 |
| R318Y/R338E/E410S | R150Y/R170E/E240S | 253 |
| R318Y/R338E/T412A | R150Y/R170E/T242A | 254 |
| R318Y/R338E/E410N/T412V | R150Y/R170E/E240N/T242V | 255 |
| D85N/K228N/R318Y/R338E/R403E/E410N | D[85]N/K63N/R150Y/R170E/R233E/E240N | 256 |
| N260S/R318Y/R338E/R403E/E410N | N95S/R150Y/R170E/R233E/E240N | 257 |
| R318Y/R338E/N346D/R403E/E410N | R150Y/R170E/N178D/R233E/E240N | 258 |
| Y155F/N346D | Y[155]F/N178D | 259 |
| Y155F/R318Y/R338E/N346D/R403E/E410N | Y[155]F/R150Y/R170E/N178D/R233E/E240N | 260 |
| Y155F/N260S/N346D | Y[155]F/N95S/N178D | 261 |
| K247N/N249S/N260S | K82N/N84S/N95S | 262 |
| Y155F/N260S | Y[155]F/N95S | 263 |
| K247N/N249S/N260S/R318Y/R338E/R403E/E410N | K82N/N84S/N95S/R150Y/R170E/R233E/E240N | 264 |
| D104/K106S/N260S/R318Y/R338E/R403E/E410N | D[104]N/K[106]S/N95S/R150Y/R170E/R233E/E240N | 265 |
| Y155F/N260S/R318Y/R338E/R403E/E410N | Y[155]F/N95S/R150Y/R170E/R233E/E240N | 266 |
| R318Y/R338E/T343R/R403E/E410N | R150Y/R170E/T175R/R233E/E240N | 267 |
| R338E/T343R | R170E/T175R | 268 |
| D104N/K106S/Y155F/N260S | D[104]N/K[106]S/Y[155]F/N95S | 269 |
| Y155F/K247N/N249S/N260S | Y[155]F/K82N/N84S/N95S | 270 |
| D104N/K106S/K247N/N249S/N260S | D[104]N/K[106]S/K82N/N84S/N95S | 271 |
| D104N/K106S/Y155F/K247N/N249S/N260S | D[104]N/K[106]S/Y[155]F/K82N/N84S/N95S | 272 |
| D104N/K106S/N260S | D[104]N/K[106]S/N95S | 185 |
| T343R/Y345T | T175R/Y177T | 215 |
| R318Y/R338E | R150Y/R170E | 188 |
| Y259F/K265T/Y345T | Y94F/K98T/Y177T | 216 |
| D104N/K106S/Y155F/K247N/N249S/R318Y/R338E/R403E/E410N | D[104]N/K[106]S/Y[155]F/K82N/N84S/R150Y/R170E/R233E/E240N | 326 |
| D104N/K106S/K228N/K247N/N249S/R318Y/R338E/R403E/E410N | D[104]N/K[106]S/K63N/K82N/N84S/R150Y/R170E/R233E/E240N | 327 |
| Y155F/K228N/K247N/N249S/R318Y/R338E/R403E/E410N | Y[155]F/K63N/K82N/N84S/R150Y/R170E/R233E/E240N | 328 |
| Y155F/K247N/N249S/N260S/R318Y/R338E/R403E/E410N | Y[155]F/K82N/N84S/N95S/R150Y/R170E/R233E/E240N | 329 |
| Y155F/R318Y/R338E/T343R/R403E/E410N | Y[155]F/R150Y/R170E/T175R/R233E/E240N | 330 |
| D104N/K106S/R318Y/R338E/T343R/R403E/E410N | D[104]N/K[106]S/R150Y/R170E/T175R/R233E/E240N | 331 |
| T343R/N346Y | T175R/N178Y | 332 |
| R318Y/R338E/N346Y/R403E/E410N | R150Y/R170E/N178Y/R233E/E240N | 333 |
| R318Y/R338E/T343R/N346Y/R403E/E410N | R150Y/R170E/T175R/N178Y/R233E/E240N | 334 |
| T343R/N346D | T175R/N178D | 335 |
| R318Y/R338E/T343R/N346D/R403E/E410N | R150Y/R170E/T175R/N178D/R233E/E240N | 336 |
| R318Y/R338E/Y345A/R403E/E410N | R150Y/R170E/Y177A/R233E/E240N | 337 |
| R318Y/R338E/Y345A/N346D/R403E/E410N | R150Y/R170E/Y177A/N178D/R233E/E240N | 338 |
| Y155F/K247N/N249S/R318Y/R338E/R403E | Y[155]F/K82N/N84S/R150Y/R170E/R233E | 339 |
| K247N/N249S/R318Y/R338E/R403E | K82N/N84S/R150Y/R170E/R233E | 340 |
| Y155F/K247N/N249S/R318Y/R403E/E410N | Y[155]F/K82N/N84S/R150Y/R233E/E240N | 341 |
| K247N/N249S/R318Y/R403E/E410N | K82N/N84S/R150Y/R233E/E240N | 342 |
| Y155F/K247N/N249S/R338E/R403E/E410N | Y[155]F/K82N/N84S/R170E/R233E/E240N | 343 |
| K247N/N249S/R338E/R403E/E410N | K82N/N84S/R170E/R233E/E240N | 344 |
| R318Y/R338E/T343R/R403E | R150Y/R170E/T175R/R233E | 345 |
| Y155F/R318Y/R338E/T343R/R403E | Y[155]F/R150Y/R170E/T175R/R233E | 346 |
| R318Y/R338E/T343R/E410N | R150Y/R170E/T175R/E240N | 347 |
| Y155F/R318Y/R338E/T343R/E410N | Y[155]F/R150Y/R170E/T175R/E240N | 348 |
| R318Y/T343R/R403E/E410N | R150Y/T175R/R233E/E240N | 349 |
| Y155F/R318Y/T343R/R403E/E410N | Y[155]F/R150Y/T175R/R233E/E240N | 350 |
| R338E/T343R/R403E/E410N | R170E/T175R/R233E/E240N | 351 |
| Y155F/R338E/T343R/R403E/E410N | Y[155]F/R170E/T175R/R233E/E240N | 352 |
| Y155F/K247N/N249S/R318Y/R338E/T343R/R403E/E410N | Y[155]F/K82N/N84S/R150Y/R170E/T175R/R233E/E240N | 353 |
| K247N/N249S/R318Y/R338E/T343R/R403E/E410N | K82N/N84S/R150Y/R170E/T175R/R233E/E240N | 354 |

TABLE 10-continued

| Mutation (Mature FIX Numbering) | Mutation (Chymotrypsin Numbering) | SEQ ID NO |
|---|---|---|
| K228N/I251S/R318Y/R338E/R403E/E410N | K63N/I86S/R150Y/R170E/R233E/E240N | 355 |
| Y155F/K228N/I251S/R318Y/R338E/R403E/E410N | Y[155]F/K63N/I86S/R150Y/R170E/R233E/E240N | 356 |
| N260S/R318Y/R338E/T343R/R403E/E410N | N95S/R150Y/R170E/T175R/R233E/E240N | 357 |
| Y155F/N260S/R318Y/R338E/T343R/R403E/E410N | Y[155]F/N95S/R150Y/R170E/T175R/R233E/E240N | 358 |
| K228N/K247N/N249S/R318Y/R338E/T343R/R403E/E410N | K63N/K82N/N84S/R150Y/R170E/T175R/R233E/E240N | 359 |
| Y155F/K228N/K247N/N249S/R318Y/R338E/T343R/R403E/E410N | Y[155]F/K63N/K82N/N84S/R150Y/R170E/T175R/R233E/E240N | 360 |
| Y155F/R338E/T343R/R403E | Y[155]F/R170E/T175R/R233E | 361 |
| R338E/T343R/R403E | R170E/T175R/R233E | 362 |
| Y155F/R338E/T343R/R403E/E410S | Y[155]F/R170E/T175R/R233E/E240S | 363 |
| Y155F/N260S/R338E/T343R/R403E | Y[155]F/N95S/R170E/T175R/R233E | 364 |
| Y155F/I251S/R338E/T343R/R403E | Y[155]F/I86S/R170E/T175R/R233E | 365 |
| R318Y/R338E/T343R/R403E/E410S | R150Y/R170E/T175R/R233E/E240S | 366 |
| Y155F/K247N/N249S/T343R/R403E | Y[155]F/K82N/N84S/T175R/R233E | 367 |
| Y155F/K247N/N249S/R318Y/R338E/T343R/R403E | Y[155]F/K82N/N84S/R150Y/R170E/T175R/R233E | 368 |
| K247N/N249S/R318Y/R338E/T343R/R403E | K82N/N84S/R150Y/R170E/T175R/R233E | 369 |
| Y155F/K247N/N249S/R338E/T343R/R403E/E410N | Y[155]F/K82N/N84S/R170E/T175R/R233E/E240N | 370 |
| K247N/N249S/R338E/T343R/R403E/E410N | K82N/N84S/R170E/T175R/R233E/E240N | 371 |
| Y155F/K247N/N249S/R318Y/R338E | Y[155]F/K82N/N84S/R150Y/R170E | 372 |
| Y155F/K247N/N249S/R318Y/T343R | Y[155]F/K82N/N84S/R150Y/T175R | 373 |
| Y155F/K247N/N249S/R318Y/R403E | Y[155]F/K82N/N84S/R150Y/R233E | 374 |
| Y155F/K247N/N249S/R318Y/E410N | Y[155]F/K82N/N84S/R150Y/E240N | 375 |
| Y155F/K247N/N249S/R338E/R403E | Y[155]F/K82N/N84S/R170E/R233E | 376 |
| Y155F/K247N/N249S/R338E/T343R | Y[155]F/K82N/N84S/R170E/T175R | 377 |
| Y155F/K247N/N249S/R318Y/R338E/T343R/E410N | Y[155]F/K82N/N84S/R150Y/R170E/T175R/E240N | 378 |
| K247N/N249S/R318Y/R338E/T343R/E410N | K82N/N84S/R150Y/R170E/T175R/E240N | 379 |
| Y155F/K247N/N249S/R318Y/T343R/R403E/E410N | Y[155]F/K82N/N84S/R150Y/T175R/R233E/E240N | 380 |
| K247N/N249S/R318Y/T343R/R403E/E410N | K82N/N84S/R150Y/T175R/R233E/E240N | 381 |
| Y155F/K247N/N249S/R338E/E410N | Y[155]F/K82N/N84S/R170E/E240N | 382 |
| Y155F/K247N/N249S/R318Y/T343R/R403E | Y[155]F/K82N/N84S/R150Y/T175R/R233E | 383 |
| K247N/N249S/R318Y/T343R/R403E | K82N/N84S/R150Y/T175R/R233E | 384 |
| Y155F/K247N/N249S/R318Y/T343R/E410N | Y[155]F/K82N/N84S/R150Y/T175R/E240N | 385 |
| K247N/N249S/R318Y/T343R/E410N | K82N/N84S/R150Y/T175R/E240N | 386 |
| Y155F/K247N/N249S/R338E/T343R/R403E | Y[155]F/K82N/N84S/R170E/T175R/R233E | 387 |
| K247N/N249S/R338E/T343R/R403E | K82N/N84S/R170E/T175R/R233E | 388 |
| Y155F/K247N/N249S/R338E/T343R/E410N | Y[155]F/K82N/N84S/R170E/T175R/E240N | 389 |
| K247N/N249S/R338E/T343R/E410N | K82N/N84S/R170E/T175R/E240N | 390 |
| Y155F/K247N/N249S/T343R/R403E/E410N | Y[155]F/K82N/N84S/T175R/R233E/E240N | 391 |
| K247N/N249S/T343R/R403E/E410N | K82N/N84S/T175R/R233E/E240N | 392 |
| Y155F/R318Y/R338E/T343R | Y[155]F/R150Y/R170E/T175R | 393 |
| R318Y/R338E/T343R | R150Y/R170E/T175R | 394 |
| Y155F/R318Y/T343R/R403E | Y[155]F/R150Y/T175R/R233E | 395 |
| Y155F/T343R/R403E/E410N | Y[155]F/T175R/R233E/E240N | 396 |
| Y155F/K247N/N249S/R318Y/R338E/T343R | Y[155]F/K82N/N84S/R150Y/R170E/T175R | 397 |
| K247N/N249S/R318Y/R338E/T343R | K82N/N84S/R150Y/R170E/T175R | 398 |
| Y155F/K247N/N249S/T343R/E410N | Y[155]F/K82N/N84S/T175R/E240N | 399 |
| Y155F/K247N/N249S/R403E/E410N | Y[155]F/K82N/N84S/R233E/E240N | 400 |
| Y155F/R338E/T343R/E410N | Y[155]F/R170E/T175R/E240N | 401 |
| R338E/T343R/E410N | R170E/T175R/E240N | 402 |
| Y155F/R318Y/T343R/E410N | Y[155]F/R150Y/T175R/E240N | 403 |
| R318Y/T343R/E410N | R150Y/T175R/E240N | 404 |
| K228N/R318Y/R338E/T343R/R403E/E410N | K63N/R150Y/R170E/T175R/R233E/E240N | 405 |
| K228N/K247N/N249S/R318Y/R338E/T343R/R403E | K63N/K82N/N84S/R150Y/R170E/T175R/R233E | 406 |
| K228N/K247N/N249S/R318Y/R338E/T343R/E410N | K63N/K82N/N84S/R150Y/R170E/T175R/E240N | 407 |

TABLE 10-continued

| Mutation (Mature FIX Numbering) | Mutation (Chymotrypsin Numbering) | SEQ ID NO |
|---|---|---|
| K228N/K247N/N249S/R318Y/T343R/R403E/E410N | K63N/K82N/N84S/R150Y/T175R/R233E/E240N | 408 |
| Y155F/R338E/R403E/E410N | Y[155]F/R170E/R233E/E240N | 409 |
| Y155F/R318Y/R338E/R403E | Y[155]F/R150Y/R170E/R233E | 410 |
| Y155F/R318Y/R403E/E410N | Y[155]F/R150Y/R233E/E240N | 411 |

3. Conjugates and Fusion Proteins

The modified FIX polypeptides provided herein can be conjugated or fused to another polypeptide or other moiety, such as a polymer. In some instances, the conjugation or fusion is effected to increase serum half-life. Exemplary polypeptides to which the modified FIX polypeptides provided herein can be fused include, but are not limited to, serum albumin, Fc, FcRn and tranferrin (see, e.g., Sheffield, W. P. et al., (2004) Br. J. Haematol. 126(4):565-73; U.S. Patent Publication No. 20050147618; International Patent Publication Nos. WO2007112005 and WO2004101740).

The modified FIX polypeptides provided herein can be conjugated to a polymer, such as dextran, a polyethylene glycol (pegylation(PEG)) or sialyl moiety, or other such polymers, such as natural or sugar polymers. In one example, the polypeptides are conjugated to dextrans, such as described elsewhere (Zambaux et al., (1998) J. Protein Chem. 17(3): 279-84). Various methods of modifying polypeptides by covalently attaching (conjugating) a PEG or PEG derivative (i.e. "PEGylation") are known in the art (see e.g., US20060104968, U.S. Pat. Nos. 5,672,662, 6,737,505 and US20040235734). Techniques for PEGylation include, but are not limited to, specialized linkers and coupling chemistries (see e.g., Harris, Adv. Drug Deliv. Rev. 54:459-476, 2002), attachment of multiple PEG moieties to a single conjugation site (such as via use of branched PEGs; see e.g., Veronese et al., Bioorg. Med. Chem. Lett. 12:177-180, 2002), site-specific PEGylation and/or mono-PEGylation (see e.g., Chapman et al., Nature Biotech. 17:780-783, 1999), site-directed enzymatic PEGylation (see e.g., Sato, Adv. Drug Deliv. Rev., 54:487-504, 2002), and glycoPEGylation (U.S. Patent Publication Nos. 20080050772, 20080146494, 20080050772, 20080187955 and 20080206808). Methods and techniques described in the art can produce proteins having 1, 2, 3, 4, 5, 6, 7, 8, 9, 10 or more PEG or PEG derivatives attached to a single protein molecule (see e.g., U.S. 2006/0104968). Thus, the modified FIX polypeptide provided herein can be pegylated, including glycopegylated, using any method known in the art, such as any described in U.S. Pat. Nos. 5,969,040, 5,621,039, 6,423,826, U.S. Patent Publication Nos. 20030211094, 20070254840, 20080188414, 2008000422, 20080050772, 20080146494, 20080050772, 20080187955 and 20080206808, International Patent Publication Nos. WO2007112005, WO2007135182, WO2008082613, WO2008119815, WO2008119815.

In some instances, the modified FIX polypeptides include amino acid replacements to facilitate conjugation to another moiety. For example, cysteine residues can be incorporated into the FIX polypeptide to facilitate conjugation to polymers. Exemplary amino acid replacement modifications for this purpose include, but are not limited to, D47C, Q50C, S53C, L57C, I66C, N67C, S68C, E70C, W72C, P74C, K80C, L84C, V86C, N89C, I90C, K91C, R94C, K100C, N101C, S102C, A103C, D104C, N105C, K106C, V108C, E114C, R116C, E119C, N120C, Q121C, S123C, E125C, P129C, S138C, T140C, S141C, K142C, A146C, E147C, E162C, T163C, I164C, L165C, D166C, N167C, I168C, T169C, Q170C, S171C, T172C, Q173C, S174C, F175C, N176C, D177C, F178C, T179C, R180C, E185C, D186C, K188C, P189C, K201C, V202C, D203C, E224C, T225C, K228C, E239C, E240C, T241C, H243C, K247C, N249C, R252C, H257C, N260C, A261C, A262C, I263C, K265C, E277C, F314C, R318C, L321C, K341C, E372C, E374C, M391C, K392C, N406C, K413C and T415C (corresponding to a mature FIX polypeptide set forth in SEQ ID NO:3).

E. Production Of Fix Polypeptides

FIX polypeptides, including modified FIX polypeptides, or domains thereof, of FIX can be obtained by methods well known in the art for protein purification and recombinant protein expression. Any method known to those of skill in the art for identification of nucleic acids that encode desired genes can be used. Any method available in the art can be used to obtain a full length (i.e., encompassing the entire coding region) cDNA or genomic DNA clone encoding a FIX polypeptide or other vitamin-K polypeptide, such as from a cell or tissue source, such as for example from liver. Modified FIX polypeptides can be engineered as described herein, such as by site-directed mutagenesis.

FIX can be cloned or isolated using any available methods known in the art for cloning and isolating nucleic acid molecules. Such methods include PCR amplification of nucleic acids and screening of libraries, including nucleic acid hybridization screening, antibody-based screening and activity-based screening.

Methods for amplification of nucleic acids can be used to isolate nucleic acid molecules encoding a FIX polypeptide, including for example, polymerase chain reaction (PCR) methods. A nucleic acid containing material can be used as a starting material from which a FIX-encoding nucleic acid molecule can be isolated. For example, DNA and mRNA preparations, cell extracts, tissue extracts (e.g. from liver), fluid samples (e.g. blood, serum, saliva), samples from healthy and/or diseased subjects can be used in amplification methods. Nucleic acid libraries also can be used as a source of starting material. Primers can be designed to amplify a FIX-encoding molecule. For example, primers can be designed based on expressed sequences from which a FIX is generated. Primers can be designed based on back-translation of a FIX amino acid sequence. Nucleic acid molecules generated by amplification can be sequenced and confirmed to encode a FIX polypeptide.

Additional nucleotide sequences can be joined to a FIX-encoding nucleic acid molecule, including linker sequences containing restriction endonuclease sites for the purpose of cloning the synthetic gene into a vector, for example, a protein expression vector or a vector designed for the amplification of the core protein coding DNA sequences. Furthermore, additional nucleotide sequences specifying functional DNA elements can be operatively linked to a FIX-encoding nucleic acid molecule. Examples of such sequences include, but are not limited to, promoter sequences designed to facilitate intracellular protein expression, and secretion sequences designed to facilitate protein secretion. Additional nucleotide sequences such as sequences specifying protein binding regions also can be linked to FIX-encoding nucleic acid molecules. Such regions include, but are not limited to, sequences to facilitate uptake of FIX into specific target cells, or otherwise enhance the pharmacokinetics of the synthetic gene.

The identified and isolated nucleic acids can then be inserted into an appropriate cloning vector. A large number of vector-host systems known in the art can be used. Possible vectors include, but are not limited to, plasmids or modified viruses, but the vector system must be compatible with the host cell used. Such vectors include, but are not limited to, bacteriophages such as lambda derivatives, or plasmids such as pBR322 or pUC plasmid derivatives or the Bluescript vector (Stratagene, La Jolla, Calif.). The insertion into a cloning vector can, for example, be accomplished by ligating the DNA fragment into a cloning vector which has complementary cohesive termini. Insertion can be effected using TOPO cloning vectors (Invitrogen, Carlsbad, Calif.). If the complementary restriction sites used to fragment the DNA are not present in the cloning vector, the ends of the DNA molecules can be enzymatically modified. Alternatively, any site desired can be produced by ligating nucleotide sequences (linkers) onto the DNA termini; these ligated linkers can contain specific chemically synthesized oligonucleotides encoding restriction endonuclease recognition sequences. In an alternative method, the cleaved vector and FIX protein gene can be modified by homopolymeric tailing. Recombinant molecules can be introduced into host cells via, for example, transformation, transfection, infection, electroporation and sonoporation, so that many copies of the gene sequence are generated.

In specific embodiments, transformation of host cells with recombinant DNA molecules that incorporate the isolated FIX protein gene, cDNA, or synthesized DNA sequence enables generation of multiple copies of the gene. Thus, the gene can be obtained in large quantities by growing transformants, isolating the recombinant DNA molecules from the transformants and, when necessary, retrieving the inserted gene from the isolated recombinant DNA.

1. Vectors and Cells

For recombinant expression of one or more of the FIX proteins, the nucleic acid containing all or a portion of the nucleotide sequence encoding the FIX protein can be inserted into an appropriate expression vector, i.e., a vector that contains the necessary elements for the transcription and translation of the inserted protein coding sequence. Exemplary of such a vector is any mammalian expression vector such as, for example, pCMV. The necessary transcriptional and translational signals also can be supplied by the native promoter for a FIX genes, and/or their flanking regions.

Also provided are vectors that contain nucleic acid encoding the FIX or modified FIX. Cells containing the vectors also are provided. The cells include eukaryotic and prokaryotic cells, and the vectors are any suitable for use therein.

Prokaryotic and eukaryotic cells, including endothelial cells, containing the vectors are provided. Such cells include bacterial cells, yeast cells, fungal cells, Archea, plant cells, insect cells and animal cells. The cells are used to produce a FIX polypeptide or modified FIX polypeptide thereof by growing the above-described cells under conditions whereby the encoded FIX protein is expressed by the cell, and recovering the expressed FIX protein. For purposes herein, the FIX can be secreted into the medium.

In one embodiment, vectors containing a sequence of nucleotides that encodes a polypeptide that has FIX activity and contains all or a portion of the FIX polypeptide, or multiple copies thereof, are provided. The vectors can be selected for expression of the FIX polypeptide or modified FIX polypeptide thereof in the cell or such that the FIX protein is expressed as a secreted protein. When the FIX is expressed the nucleic acid is linked to nucleic acid encoding a secretion signal, such as the *Saccharomyces cerevisiae* α-mating factor signal sequence or a portion thereof, or the native signal sequence.

A variety of host-vector systems can be used to express the protein coding sequence. These include but are not limited to mammalian cell systems infected with virus (e.g. vaccinia virus, adenovirus and other viruses); insect cell systems infected with virus (e.g. baculovirus); microorganisms such as yeast containing yeast vectors; or bacteria transformed with bacteriophage, DNA, plasmid DNA, or cosmid DNA. The expression elements of vectors vary in their strengths and specificities. Depending on the host-vector system used, any one of a number of suitable transcription and translation elements can be used.

Any methods known to those of skill in the art for the insertion of DNA fragments into a vector can be used to construct expression vectors containing a chimeric gene containing appropriate transcriptional/translational control signals and protein coding sequences. These methods can include in vitro recombinant DNA and synthetic techniques and in vivo recombinants (genetic recombination). Expression of nucleic acid sequences encoding a FIX polypeptide or modified FIX polypeptide, or domains, derivatives, fragments or homologs thereof, can be regulated by a second nucleic acid sequence so that the genes or fragments thereof are expressed in a host transformed with the recombinant DNA molecule(s). For example, expression of the proteins can be controlled by any promoter/enhancer known in the art. In a specific embodiment, the promoter is not native to the genes for a FIX protein. Promoters which can be used include but are not limited to the SV40 early promoter (Bemoist and Chambon, *Nature* 290:304-310 (1981)), the promoter contained in the 3' long terminal repeat of Rous sarcoma virus (Yamamoto et al. *Cell* 22:787-797 (1980)), the herpes thymidine kinase promoter (Wagner et al., *Proc. Natl. Acad. Sci. USA* 78:1441-1445 (1981)), the regulatory sequences of the metallothionein gene (Minster et al., *Nature* 296:39-42 (1982)); prokaryotic expression vectors such as the β-lactamase promoter (Jay et al., (1981) *Proc. Natl. Acad. Sci. USA* 78:5543) or the tac promoter (DeBoer et al., *Proc. Natl. Acad. Sci. USA* 80:21-25 (1983)); see also "Useful Proteins from Recombinant Bacteria": in Scientific American 242:79-94 (1980)); plant expression vectors containing the nopaline synthetase promoter (Herrara-Estrella et al., *Nature* 303:209-213 (1984)) or the cauliflower mosaic virus 35S RNA promoter (Garder et al, *Nucleic Acids Res.* 9:2871 (1981)), and the promoter of the photosynthetic enzyme ribulose bisphosphate carboxylase (Herrera-Estrella et al., *Nature* 310:115-120 (1984)); promoter elements from yeast and other fungi such as the Gal4 promoter, the alcohol dehydrogenase promoter, the phosphoglycerol kinase promoter, the alkaline phosphatase promoter, and the following animal transcriptional control regions that exhibit tissue specificity and have been used in transgenic animals: elastase I gene control region which is active in pancreatic acinar cells (Swift et al., *Cell* 38:639-646 (1984); Ornitz et al., *Cold Spring Harbor Symp. Quant. Biol.* 50:399-409 (1986); MacDonald, *Hepatology* 7:425-515 (1987)); insulin gene control region which is active in pancreatic beta cells (Hanahan et al., *Nature*

315:115-122 (1985)), immunoglobulin gene control region which is active in lymphoid cells (Grosschedl et al., *Cell* 38:647-658 (1984); Adams et al., *Nature* 318:533-538 (1985); Alexander et al., *Mol. Cell. Biol.* 7:1436-1444 (1987)), mouse mammary tumor virus control region which is active in testicular, breast, lymphoid and mast cells (Leder et al., *Cell* 45:485-495 (1986)), albumin gene control region which is active in liver (Pinkert et al., *Genes and Devel.* 1:268-276 (1987)), alpha-fetoprotein gene control region which is active in liver (Krumlauf et al., *Mol. Cell. Biol.* 5:1639-1648 (1985); Hammer et al., *Science* 235:53-58 1987)), alpha-1 antitrypsin gene control region which is active in liver (Kelsey et al., *Genes and Devel.* 1:161-171 (1987)), beta globin gene control region which is active in myeloid cells (Magram et al., *Nature* 315:338-340 (1985); Kollias et al., *Cell* 46:89-94 (1986)), myelin basic protein gene control region which is active in oligodendrocyte cells of the brain (Readhead et al., *Cell* 48:703-712 (1987)), myosin light chain-2 gene control region which is active in skeletal muscle (Shani, *Nature* 314:283-286 (1985)), and gonadotrophic releasing hormone gene control region which is active in gonadotrophs of the hypothalamus (Mason et al., *Science* 234:1372-1378 (1986)).

In a specific embodiment, a vector is used that contains a promoter operably linked to nucleic acids encoding a FIX polypeptide or modified FIX polypeptide, or a domain, fragment, derivative or homolog, thereof, one or more origins of replication, and optionally, one or more selectable markers (e.g., an antibiotic resistance gene). Vectors and systems for expression of FIX polypeptides include the well known *Pichia* vectors (available, for example, from Invitrogen, San Diego, Calif.), particularly those designed for secretion of the encoded proteins. Exemplary plasmid vectors for expression in mammalian cells include, for example, pCMV. Exemplary plasmid vectors for transformation of *E. coli* cells, include, for example, the pQE expression vectors (available from Qiagen, Valencia, Calif.; see also literature published by Qiagen describing the system). pQE vectors have a phage T5 promoter (recognized by *E. coli* RNA polymerase) and a double lac operator repression module to provide tightly regulated, high-level expression of recombinant proteins in *E. coli*, a synthetic ribosomal binding site (RBS II) for efficient translation, a 6× His tag coding sequence, $t_0$ and T1 transcriptional terminators, ColE1 origin of replication, and a beta-lactamase gene for conferring ampicillin resistance. The pQE vectors enable placement of a 6× His tag at either the N- or C-terminus of the recombinant protein. Such plasmids include pQE 32, pQE 30, and pQE 31 which provide multiple cloning sites for all three reading frames and provide for the expression of N-terminally 6× His-tagged proteins. Other exemplary plasmid vectors for transformation of *E. coli* cells, include, for example, the pET expression vectors (see, U.S. Pat. No. 4,952,496; available from NOVAGEN, Madison, Wis.; see, also literature published by Novagen describing the system). Such plasmids include pET 11a, which contains the T7 lac promoter, T7 terminator, the inducible *E. coli* lac operator, and the lac repressor gene; pET 12a-c, which contains the T7 promoter, T7 terminator, and the *E. coli* ompT secretion signal; and pET 15b and pET19b (NOVAGEN, Madison, Wis.), which contain a His-Tag™ leader sequence for use in purification with a His column and a thrombin cleavage site that permits cleavage following purification over the column, the T7-lac promoter region and the T7 terminator.

2. Expression Systems

FIX polypeptides (modified and unmodified) can be produced by any methods known in the art for protein production including in vitro and in vivo methods such as, for example, the introduction of nucleic acid molecules encoding FIX into a host cell, host animal and expression from nucleic acid molecules encoding FIX in vitro. FIX and modified FIX polypeptides can be expressed in any organism suitable to produce the required amounts and forms of a FIX polypeptide needed for administration and treatment. Expression hosts include prokaryotic and eukaryotic organisms such as *E. coli*, yeast, plants, insect cells, mammalian cells, including human cell lines and transgenic animals. Expression hosts can differ in their protein production levels as well as the types of post-translational modifications that are present on the expressed proteins. The choice of expression host can be made based on these and other factors, such as regulatory and safety considerations, production costs and the need and methods for purification.

Expression in eukaryotic hosts can include expression in yeasts such as *Saccharomyces cerevisiae* and *Pichia pastoris*, insect cells such as *Drosophila* cells and *lepidopteran* cells, plants and plant cells such as tobacco, corn, rice, algae, and lemna. Eukaryotic cells for expression also include mammalian cells lines such as Chinese hamster ovary (CHO) cells or baby hamster kidney (BHK) cells. Eukaryotic expression hosts also include production in transgenic animals, for example, including production in serum, milk and eggs. Transgenic animals for the production of wild-type FIX polypeptides are known in the art (U.S. Patent Publication Nos. 2002-0166130 and 2004-0133930) and can be adapted for production of modified FIX polypeptides provided herein.

Many expression vectors are available and known to those of skill in the art for the expression of FIX. The choice of expression vector is influenced by the choice of host expression system. Such selection is well within the level of skill of the skilled artisan. In general; expression vectors can include transcriptional promoters and optionally enhancers, translational signals, and transcriptional and translational termination signals. Expression vectors that are used for stable transformation typically have a selectable marker which allows selection and maintenance of the transformed cells. In some cases, an origin of replication can be used to amplify the copy number of the vectors in the cells.

FIX or modified FIX polypeptides also can be utilized or expressed as protein fusions. For example, a fusion can be generated to add additional functionality to a polypeptide. Examples of fusion proteins include, but are not limited to, fusions of a signal sequence, a tag such as for localization, e.g. a $his_6$ tag or a myc tag, or a tag for purification, for example, a GST fusion, and a sequence for directing protein secretion and/or membrane association.

In one embodiment, the FIX polypeptide or modified FIX polypeptides can be expressed in an active form, whereby activation is achieved by incubation of the polypeptide activated factor XI (FXIa) following secretion. In another embodiment, the protease is expressed in an inactive, zymogen form.

Methods of production of FIX polypeptides can include coexpression of one or more additional heterologous polypeptides that can aid in the generation of the FIX polypeptides. For example, such polypeptides can contribute to the post-translation processing of the FIX polypeptides. Exemplary polypeptides include, but are not limited to, peptidases that help cleave FIX precursor sequences, such as the propeptide sequence, and enzymes that participate in the modification of the FIX polypeptide, such as by glycosylation, hydroxylation, carboxylation, or phosphorylation, for example. An exemplary peptidase that can be coexpressed with FIX is PACE/furin (or PACE-SOL), which aids in the cleavage of the FIX propeptide sequence. An exemplary protein that aids in the carboxylation of the FIX polypeptide is the warfarin-sensitive enzyme vitamin K 2,3-epoxide reductase (VKOR), which produces reduced vitamin K for utilization as a cofactor by the vitamin K-dependent γ-carboxylase (Wajih et al., *J. Biol. Chem.* 280(36)31603-31607). A subunit of this enzyme, VKORC1, can be coexpressed with the modified FIX polypeptide to increase the γ-carboxylation The one or more additional polypeptides can be expressed from the same expression vector as the FIX polypeptide or from a different vector.

a. Prokaryotic Expression

Prokaryotes, especially *E. coli*, provide a system for producing large amounts of FIX (see, for example, Platis et al. (2003) Protein Exp. Purif. 31(2): 222-30; and Khalilzadeh et al. (2004) J. Ind. Microbiol. Biotechnol. 31(2): 63-69). Transformation of *E. coli* is a simple and rapid technique well known to those of skill in the art. Expression vectors for *E. coli* can contain inducible promoters that are useful for inducing high levels of protein expression and for expressing proteins that exhibit some toxicity to the host cells. Examples of inducible promoters include the lac promoter, the trp promoter, the hybrid tac promoter, the T7 and SP6 RNA promoters and the temperature regulated λP$_L$ promoter.

FIX can be expressed in the cytoplasmic environment of *E. coli*. The cytoplasm is a reducing environment and for some molecules, this can result in the formation of insoluble inclusion bodies. Reducing agents such as dithiothreitol and β-mercaptoethanol and denaturants (e.g., such as guanidine-HCl and urea) can be used to resolubilize the proteins. An alternative approach is the expression of FIX in the periplasmic space of bacteria which provides an oxidizing environment and chaperonin-like and disulfide isomerases leading to the production of soluble protein. Typically, a leader sequence is fused to the protein to be expressed which directs the protein to the periplasm. The leader is then removed by signal peptidases inside the periplasm. Examples of periplasmic-targeting leader sequences include the pelB leader from the pectate lyase gene and the leader derived from the alkaline phosphatase gene. In some cases, periplasmic expression allows leakage of the expressed protein into the culture medium. The secretion of proteins allows quick and simple purification from the culture supernatant. Proteins that are not secreted can be obtained from the periplasm by osmotic lysis. Similar to cytoplasmic expression, in some cases proteins can become insoluble and denaturants and reducing agents can be used to facilitate solubilization and refolding. Temperature of induction and growth also can influence expression levels and solubility. Typically, temperatures between 25° C. and 37° C. are used. Mutations also can be used to increase solubility of expressed proteins. Typically, bacteria produce aglycosylated proteins. Thus, for the production of the hyperglycosylated FIX polypeptides provided herein, glycosylation can be added in vitro after purification from host cells.

b. Yeast

Yeasts such as *Saccharomyces cerevisiae, Schizosaccharomyces pombe, Yarrowia lipolytica, Kluyveromyces lactis*, and *Pichia pastoris* are useful expression hosts for FIX (see for example, Skoko et al. (2003) Biotechnol. Appl. Biochem. 38(Pt3):257-65). Yeast can be transformed with episomal replicating vectors or by stable chromosomal integration by homologous recombination. Typically, inducible promoters are used to regulate gene expression. Examples of such promoters include GAL1, GAL7, and GAL5 and metallothionein promoters such as CUP1. Expression vectors often include a selectable marker such as LEU2, TRP1, HIS3, and URA3 for selection and maintenance of the transformed DNA. Proteins expressed in yeast are often soluble and coexpression with chaperonins, such as Bip and protein disulfide isomerase, can improve expression levels and solubility. Additionally, proteins expressed in yeast can be directed for secretion using secretion signal peptide fusions such as the yeast mating type alpha-factor secretion signal from *Saccharomyces cerevisiae* and fusions with yeast cell surface proteins such as the Aga2p mating adhesion receptor or the *Arxula adeninivorans* glucoamylase. A protease cleavage site (e.g., the Kex-2 protease) can be engineered to remove the fused sequences from the polypeptides as they exit the secretion pathway. Yeast also is capable of glycosylation at Asn-X-Ser/Thr motifs.

c. Insects and Insect Cells

Insects and insect cells, particularly using a baculovirus expression system, are useful for expressing polypeptides such as FIX or modified forms thereof (see, for example, Muneta et al. (2003) J. Vet. Med. Sci. 65(2):219-23). Insect cells and insect larvae, including expression in the haemolymph, express high levels of protein and are capable of most of the post-translational modifications used by higher eukaryotes. Baculoviruses have a restrictive host range which improves the safety and reduces regulatory concerns of eukaryotic expression. Typically, expression vectors use a promoter such as the polyhedrin promoter of baculovirus for high level expression. Commonly used baculovirus systems include baculoviruses such as *Autographa californica* nuclear polyhedrosis virus (AcNPV), and the *Bombyx mori* nuclear polyhedrosis virus (BmNPV) and an insect cell line such as Sf9 derived from *Spodoptera frugzperda, Pseudaletia unipuncta* (A7S) and *Danaus plexippus* (DpN1). For high level expression, the nucleotide sequence of the molecule to be expressed is fused immediately downstream of the polyhedrin initiation codon of the virus. Mammalian secretion signals are accurately processed in insect cells and can be used to secrete the expressed protein into the culture medium. In addition, the cell lines *Pseudaletia unipuncta* (A7S) and *Danaus plexippus* (DpN1) produce proteins with glycosylation patterns similar to mammalian cell systems.

An alternative expression system in insect cells is the use of stably transformed cells. Cell lines such as the Schnieder 2 (S2) and Kc cells (*Drosophila melanogaster*) and C7 cells (*Aedes albopictus*) can be used for expression. The *Drosophila* metallothionein promoter can be used to induce high levels of expression in the presence of heavy metal induction with cadmium or copper. Expression vectors are typically maintained by the use of selectable markers such as neomycin and hygromycin.

d. Mammalian Cells

Mammalian expression systems can be used to express FIX polypeptides. Expression constructs can be transferred to mammalian cells by viral infection such as adenovirus or by direct DNA transfer such as liposomes, calcium phosphate, DEAE-dextran and by physical means such as electroporation and microinjection. Expression vectors for mammalian cells typically include an mRNA cap site, a TATA box, a translational initiation sequence (Kozak consensus sequence) and polyadenylation elements. Such vectors often include transcriptional promoter-enhancers for high level expression, for example the SV40 promoter-enhancer, the human cytomegalovirus (CMV) promoter, and the long terminal repeat of Rous sarcoma virus (RSV). These promoter-enhancers are active in many cell types. Tissue and cell-type promoters and enhancer regions also can be used for expression. Exemplary promoter/enhancer regions include, but are not limited to, those from genes such as elastase I, insulin, immunoglobulin, mouse mammary tumor virus, albumin, alpha-fetoprotein, alpha 1-antitrypsin, beta-globin, myelin basic protein, myosin light chain-2, and gonadotropic releasing hormone gene control. Selectable markers can be used to select for and maintain cells with the expression construct. Examples of selectable marker genes include, but are not limited to, hygromycin B phosphotransferase, adenosine deaminase, xanthine-guanine phosphoribosyl transferase, aminoglycoside phosphotransferase, dihydrofolate reductase and thymidine kinase. Fusion with cell surface signaling molecules such as TCR-ζ and Fc$_\epsilon$RI-γ can direct expression of the proteins in an active state on the cell surface.

Many cell lines are available for mammalian expression including mouse, rat human, monkey, and chicken and hamster cells. Exemplary cell lines include, but are not limited to, BHK (i.e. BHK-21 cells), 293-F, CHO, CHO Express (CHOX; Excellgene), Balb/3T3, HeLa, MT2, mouse NS0 (non-secreting) and other myeloma cell lines, hybridoma and heterohybridoma cell lines, lymphocytes, fibroblasts, Sp2/0, COS, NIH3T3, HEK293, 293S, 293T, 2B8, and HKB cells. Cell lines also are available adapted to serum-free media which facilitates purification of secreted proteins from the cell culture media. One such example is the serum free EBNA-1 cell line (Pham et al., (2003) *Biotechnol. Bioeng.* 84:332-42). Expression of recombinant FIX polypeptides exhibiting similar structure and post-translational modifications as plasma-derived FIX are known in the art. Methods of optimizing vitamin K-dependent protein expression are known. For example, supplementation of vitamin K in culture medium or co-expression of vitamin K-dependent γ-carboxylases (Wajih et al., *J. Biol. Chem.* 280(36)31603-31607) can aid in post-translational modification of vitamin K-dependent proteins, such as FIX polypeptides.

e. Plants

Transgenic plant cells and plants can be used for the expression of FIX. Expression constructs are typically transferred to plants using direct DNA transfer such as microprojectile bombardment and PEG-mediated transfer into protoplasts, and with agrobacterium-mediated transformation. Expression vectors can include promoter and enhancer sequences, transcriptional termination elements, and translational control elements. Expression vectors and transformation techniques are usually divided between dicot hosts, such as *Arabidopsis* and tobacco, and monocot hosts, such as corn and rice. Examples of plant promoters used for expression include the cauliflower mosaic virus promoter, the nopaline synthase promoter, the ribose bisphosphate carboxylase promoter and the ubiquitin and UBQ3 promoters. Selectable markers such as hygromycin, phosphomannose isomerase and neomycin phosphotransferase are often used to facilitate selection and maintenance of transformed cells. Transformed plant cells can be maintained in culture as cells, aggregates (callus tissue) or regenerated into whole plants. Because plants have different glycosylation patterns than mammalian cells, this can influence the choice to produce FIX in these hosts. Transgenic plant cells also can include algae engineered to produce proteins (see, for example, Mayfield et al. (2003) *Proc Natl Acad Sci USA* 100:438-442). Because plants have different glycosylation patterns than mammalian cells, this can influence the choice to produce FIX in these hosts.

2. Purification

Methods for purification of FIX polypeptides from host cells depend on the chosen host cells and expression systems. For secreted molecules, proteins are generally purified from the culture media after removing the cells. For intracellular expression, cells can be lysed and the proteins purified from the extract. When transgenic organisms such as transgenic plants and animals are used for expression, tissues or organs can be used as starting material to make a lysed cell extract. Additionally, transgenic animal production can include the production of polypeptides in milk or eggs, which can be collected, and if necessary further the proteins can be extracted and further purified using standard methods in the art.

FIX can be purified using standard protein purification techniques known in the art including but not limited to, SDS-PAGE, size fraction and size exclusion chromatography, ammonium sulfate precipitation, chelate chromatography and ionic exchange chromatography. For example, FIX polypeptides can be purified by anion exchange chromatography, such as described in Example 1, below. Exemplary of a method to purify FIX polypeptides is by using an ion exchange column that permits binding of any polypeptide that has a functional Gla domain, followed by elution in the presence of calcium. Affinity purification techniques also can be used to improve the efficiency and purity of the preparations. For example, antibodies, receptors and other molecules that bind FIX can be used in affinity purification. Expression constructs also can be engineered to add an affinity tag such as a myc epitope, GST fusion or His$_6$ and affinity purified with myc antibody, glutathione resin, and Ni-resin, respectively, to a protein. Purity can be assessed by any method known in the art including gel electrophoresis and staining and spectrophotometric techniques.

The FIX polypeptide can be expressed and purified to be in an inactive form (zymogen form) or alternatively the expressed protease can be purified into an active form, such as by autocatalysis. For example, FIX polypeptides that have been activated via proteolytic cleavage after R145 and R180 can be prepared in vitro (i.e. FIXa; two-chain form). The FIX polypeptides can be first prepared by any of the methods of production described herein, including, but not limited to, production in mammalian cells followed by purification. Cleavage of the FIX polypeptides into the active protease form, FIXa, can be accomplished by incubation with factor XIa. In some examples, this is performed in the presence of calcium and phospholipids.

3. Fusion Proteins

Fusion proteins containing a modified FIX polypeptide and one or more other polypeptides also are provided. Pharmaceutical compositions containing such fusion proteins formulated for administration by a suitable route are provided. Fusion proteins are formed by linking in any order the modified FIX polypeptide and an agent, such as an antibody or fragment thereof, growth factor, receptor, ligand, and other such agent for the purposes of facilitating the purification of a FIX polypeptide, altering the pharmacodynamic properties of a FIX polypeptide by directing, for example, by directing the polypeptide to a targeted cell or tissue, and/or increasing the expression or secretion of the FIX polypeptide. Typically any FIX fusion protein retains at least about 30%, 40%, 50%, 60%, 70%, 80%, 90%, or 95% coagulant activity compared with a non-fusion FIX polypeptide, including 96%, 97%, 98%, 99% or greater coagulant activity compared with a non-fusion polypeptide.

Linkage of a FIX polypeptide with another polypeptide can be effected directly or indirectly via a linker. In one example, linkage can be by chemical linkage, such as via heterobifunctional agents or thiol linkages or other such linkages. Fusion also can be effected by recombinant means. Fusion of a FIX polypeptide to another polypeptide can be to the N- or C-terminus of the FIX polypeptide. Non-limiting examples of polypeptides that can be used in fusion proteins with a FIX polypeptide provided herein include, for example, a GST (glutathione S-transferase) polypeptide, Fc domain from immunoglobulin G, albumin, or a heterologous signal sequence. The fusion proteins can contain additional components, such as *E. coli* maltose binding protein (MBP) that aid in uptake of the protein by cells (see, International PCT application No. WO 01/32711).

A fusion protein can be produced by standard recombinant techniques. For example, DNA fragments coding for the different polypeptide sequences can be ligated together in-frame in accordance with conventional techniques, e.g., by employing blunt-ended or stagger-ended termini for ligation, restriction enzyme digestion to provide for appropriate termini, filling-in of cohesive ends as appropriate, alkaline phosphatase treatment to avoid undesirable joining, and enzymatic ligation. In another embodiment, the fusion gene can be synthesized by conventional techniques including automated DNA synthesizers. Alternatively, PCR amplification of gene fragments can be carried out using anchor primers that give rise to complementary overhangs between two consecutive gene fragments that can subsequently be annealed and reamplified to generate a chimeric gene sequence (see, e.g., Ausubel et al. (eds.) Current Protocols in Molecular Biology, John Wiley & Sons, 1992). Moreover, many expression vectors are commercially available that already encode a fusion moiety (e.g., a GST polypeptide). A FIX-encoding nucleic acid can be cloned into such an expression vector such that the fusion moiety is linked in-frame to the protease protein.

4. Polypeptide Modification

Modified FIX polypeptides can be prepared as unmodified (or naked) polypeptide chains or as posttranslationally modified polypeptides. For some applications, it can be desirable to prepare modified FIX in a "naked" form without post-translational or other chemical modifications. Naked polypeptide chains can be prepared in suitable hosts that do not post-translationally modify FIX. Such polypeptides also can be prepared in in vitro systems and using chemical polypeptide synthesis. For other applications, particular modifications can be desired. In particular, for the purposes herein, glycosylation of the modified FIX polypeptides to produce hyperglycosylated FIX polypeptides is preferred. Such glycosylation can be performed in vivo using an appropriate expression system, such as a mammalian expression system, in vitro (see e.g. Mikami et al. (2006) J. Biotechnol. 127:65-78), or a combination of in vivo and in vitro methods in which, for example, the FIX polypeptide is expressed in prokaryotic cells and further modified in vitro using enzymatic transglycosylation (see e.g. Schwarz et al., (2010) Nature Chem. Biol. 6:264-266). Additionally, pegylation, albumination, carboxylation, hydroxylation, phosphorylation, or other known modifications can be desired. Modifications can be made in vitro or, for example, by producing the modified FIX in a suitable host that produces such modifications.

5. Nucleotide Sequences

Nucleic acid molecules encoding FIX or modified FIX polypeptides are provided herein. Nucleic acid molecules include allelic variants or splice variants of any encoded FIX polypeptide. Exemplary of nucleic acid molecules provided herein are any that encode a modified FIX polypeptide provided herein, such as any encoding a polypeptide set forth in any of SEQ ID NOS:75-272. In one embodiment, nucleic acid molecules provided herein have at least 50, 60, 65, 70, 75, 80, 85, 90, 91, 92, 93, 94, 95, or 99% sequence identity or hybridize under conditions of medium or high stringency along at least 70% of the full-length of any nucleic acid encoding a FIX polypeptide provided herein. For example, the nucleic acid molecules provided herein have at least or at least about 50, 60, 65, 70, 75, 80, 85, 90, 91, 92, 93, 94, 95, or 99% sequence identity to the nucleic acid sequence set forth in SEQ ID NO:1. In another embodiment, a nucleic acid molecule can include those with degenerate codon sequences encoding any of the FIX polypeptides provided herein.

F. Assessing Modified Fix Polypeptide Activities

The activities and properties of FIX polypeptides can be assessed in vitro and/or in vivo. Assays for such assessment are known to those of skill in the art and are known to correlate tested activities and results to therapeutic and in vivo activities. In one example, FIX variants can be assessed in comparison to unmodified and/or wild-type FIX. Such assays can be performed in the presence or absence of FVIIIa, phospholipids and/or calcium. In vitro assays include any laboratory assay known to one of skill in the art, such as for example, cell-based assays including coagulation assays, binding assays, protein assays, and molecular biology assays. In vivo assays include FIX assays in animal models as well as administration to humans. In some cases, activity of FIX polypeptides in vivo can be determined by assessing blood, serum, or other bodily fluid for assay determinants. FIX variants, such as those provided herein, also can be tested in vivo to assess an activity or property, such as therapeutic effect.

Typically, assays described herein are with respect to the two-chain activated form of FIX, i.e. FIXa. FIX polypeptides that have been activated via proteolytic cleavage after R145 and R180 can be prepared in vitro. The FIX polypeptides can be first prepared by any of the methods of production described herein, including, but not limited to, production in mammalian cells followed by purification. Cleavage of the FIX polypeptides into the active protease form of FIX can be accomplished by incubation with activated factor XI (FXIa). The activated polypeptides can be used in any of the assays to measure FIX activities described herein. Such assays also can be performed with the single chain zymogen form. For example, a single chain zymogen FIX polypeptide can provide a negative control since such a form typically does not exhibit the proteolytic or catalytic activity required for the coagulant activity of FIX. In addition, such assays also can be performed in the presence of cofactors, such as FVIIIa, and other molecules, such as phospholipids and/or calcium, which in can augment the activity of FIX.

1. In Vitro Assays

Exemplary in vitro assays include assays to assess polypeptide modification and activity. Modifications can be assessed using in vitro assays that assess glycosylation, γ-carboxylation and other post-translational modifications, protein assays and conformational assays known in the art. Assays for activity include, but are not limited to, measurement of FIX interaction with other coagulation factors, such as FVIIIa and factor X, proteolytic assays to determine the proteolytic activity of FIX polypeptides, assays to determine the binding and/or affinity of FIX polypeptides for phosphatidylserines and other phospholipids, and cell based assays to determine the effect of FIX polypeptides on coagulation.

Concentrations of modified FIX polypeptides can be assessed by methods well-known in the art, including but not limited to, enzyme-linked immunosorbant assays (ELISA), SDS-PAGE; Bradford, Lowry, BCA methods; UV absorbance, and other quantifiable protein labeling methods, such as, but not limited to, immunological, radioactive and fluorescent methods and related methods. Assessment of cleavage products of proteolysis reactions, including cleavage of FIX polypeptides or products produced by FIX protease activity, can be performed using methods including, but not limited to, chromogenic substrate cleavage, HPLC, SDS- PAGE analysis, ELISA, Western blotting, immunohistochemistry, immunoprecipitation, $NH_2$-terminal sequencing, fluorescence, and protein labeling.

Structural properties of modified FIX polypeptides can also be assessed. For example, X-ray crystallography, nuclear magnetic resonance (NMR), and cryoelectron microscopy (cryo-EM) of modified FIX polypeptides can be performed to assess three-dimensional structure of the FIX polypeptides and/or other properties of FIX polypeptides, such as $Ca^{2+}$ or cofactor binding.

Additionally, the presence and extent of FIX degradation can be measured by standard techniques such as sodium dodecyl sulfate polyacrylamide gel electrophoresis (SDS-PAGE), and Western blotting of electrophoresed FIX-containing samples. FIX polypeptides that have been exposed to proteases also can be subjected to N-terminal sequencing to determine location or changes in cleavage sites of the modified FIX polypeptides.

a. Glycosylation

FIX polypeptides can be assessed for the presence of glycosylation using methods well known in the art. Glycosylation of a polypeptide can been characterized from its enzymatically or chemically released carbohydrate pool, using a wide variety of methods, such as high pH anion exchange chromatography (Townsend et al., (1991) Glycobiology 1:139-147), or fluorophore-assisted carbohydrate electrophoresis (FACE) (Kumar et al., (1996) Biotechnol. Appl. Biochem. 24:207-214.), sequential exoglycosidase digestions (Watzlawick et al., (1992) Biochemistry 31:12198-12203; Tyagarajan et al., (1996) Glycobiology, 6:83-93), mass spectrometry (Gillece-Castro et al., (1990) Meth. Enzymol. 193: 689-712; Duffin et al., (1992) Anal. Chem. 64:1440-1448; Papac et al., (1997) in Techniques in Glycobiology (Townsend R. R. and Hotchkiss A. T. eds.) Marcel Decker, Inc., New York, pp. 33-52; Fu et al., (1994) Carbohydr. Res. 261:173-186) and NMR (Fu et al., (1994) Carbohydr. Res. 261:173-186).

For example, chemical release can be effected by hydrazinolysis, which releases N- and O-linked glycans from glycoproteins by incubation with anhydrous hydrazine. Enzymatic release can be effected by the endoglycosidases peptide N-glycosidase F (PNGase F), which removes unaltered most of the common N-linked carbohydrates from the polypeptide while hydrolyzing the originally glycosylated Asn residue to Asp. Hydrazinolysis or endoglycosidase treatment of FIX polypeptides generates a reducing terminus that can be tagged with a fluorophore or chromophore label. Labeled FIX polypeptides can be analyzed by fluorophore-assisted carbohydrate electrophoresis (FACE). The fluorescent tag for glycans also can be used for monosaccharide analysis, profiling or fingerprinting of complex glycosylation patterns by HPLC. Exemplary HPLC methods include hydrophilic interaction chromatography, electronic interaction, ion-exchange, hydrophobic interaction, and size-exclusion chromatography. Exemplary glycan probes include, but are not limited to, 3-(acetylamino)-6-aminoacridine (AA-Ac) and 2-aminobenzoic acid (2-AA). Carbohydrate moieties can also be detected through use of specific antibodies that recognize the glycosylated FIX polypeptide.

In one method, mass spectrometry is used to assess site-specific carbohydrate heterogeneity. This can involve matrix-assisted laser desorption ionization mass spectrometry of collected HPLC-fractions (Sutton et al., (1994) Anal. Biochem. 218:34-46; Ploug et al., (1998) J. Biol. Chem. 273:13933-13943), or reversed phase HPLC directly coupled with electrospray ionization mass spectrometry (LC/ESIMS) (see, e.g., Huddleston et al., (1993) Anal. Chem. 65:877-884; Medzihradsky et al., (2008) Methods Mol. Biol. 446:293-316). In one example, glycosylation at potential N-glycosylation sites, such as an asparagine residue within an Asn-X-Ser/Thr/Cys motif, is assessed by LC/ESIMS. The potential N-glycosylation sites in a FIX polypeptide can be identified, and a proteolytic enzyme can be selected that would separate these sites on individual peptides. The digestion mixture is then analyzed by LC/ESIMS, a method that generates diagnostic carbohydrate ions by collisional activation (33). These diagnostic carbohydrate ions include, for example, characteristic nonreducing end oxonium ions at m/z 204, 274 and 292, 366, and 657, which indicate the presence of N-acetylhexosamine, neuraminic (sialic) acid, hexosyl-N-acetylhexosamine, and sialyl-hexosyl-Nacetylhexosamine, respectively. In addition to identifying the presence of these ions by selective ion monitoring (SIM), the LC/ESIMS method also analyzes the peptide to assess the molecular weight, which can be used to indicate which peptide, and, therefore, which potential N-glycosylation site, contains the carbohydrate.

b. Other Post-translational Modifications

FIX polypeptides can be assessed for the presence of post-translational modifications other than glycosylation. Such assays are known in the art and include assays to measure hydroxylation, sulfation, phosphorylation and carboxylation. An exemplary assay to measure β-hydroxylation comprises reverse phase HPLC analysis of FIX polypeptides that have been subjected to alkaline hydrolysis (Przysiecki et al. (1987) PNAS 84:7856-7860). Carboxylation and γ-carboxylation of FIX polypeptides can be assessed using mass spectrometry with matrix-assisted laser desorption ionization time-of-flight (MALDI-TOF) analysis, as described for other vitamin K-dependent polypeptides (se, e.g. Harvey et al. J Biol Chem 278:8363-8369, Maun et al. Prot Sci 14:1171-1180). The interaction of a FIX polypeptide containing the propeptide (pro-FIX) with the carboxylase responsible for post-translational γ-carboxylate modification also can be assessed. The dissociation constant ($K_d$) following incubation of carboxylase with flourescein-labeled pro-FIX polypeptides can be measured by determining the amount of bound carboxylase by anisotropy (Lin et al. (2004) J Biol Chem 279:6560-6566). Other exemplary assays to measure carboxylation include reverse phase HPLC analysis of FIX polypeptides that have been subjected to alkaline hydrolysis (Przysiecki et al. (1987) *PNAS* 84: 7856-7860).

Exemplary assays to measure phosphorylation include use of phosphospecific antibodies to phospho-serine and/or -tyrosine amino acid residues or to a serine-phosphorylated FIX polypeptide. $^{32}P$ metabolic labeling of cells that produce the FIX polypeptide also can be used to assess phosphorylation, wherein the labeled FIX polypeptide can be purified and analyzed for incorporation of radioactive phosphate. An exemplary assay for tyrosine sulfation includes $^{35}S$ labeling of cells that produce the FIX polypeptide. In such method, cells are incubated with either $^{35}S-S_2SO_4$ or $^{35}S$-methionine and incorporation of the $^{35}S$ is determined by normalization to the $^{35}S$-methionine sample.

c. Proteolytic Activity

Modified FIX polypeptides can be tested for proteolytic activity towards both synthetic substrates and it's natural substrate, Factor X. Activated forms of the modified FIX polypeptides (FIXa) typically are used in the assay. Assays using a synthetic substrate, such as a $CH_3SO_2$-LGR-pNA peptide, can be employed to measure enzymatic cleavage activity of the FIXa polypeptides. Hydrolysis of $CH_3SO_2$-LGR-pNA in the presence of FIXa can be measured by assessing the production of p-nitroanaline (pNA) from the cleavage reaction sample. The amount of pNA in the sample is proportional to the absorbance of the sample at 405 nm and thus indicates the extent of proteolytic activity in the FIXa sample. Additional exemplary fluorogenic substrates that can be used to assess FIXa cleavage activity include, but are not limited to, Mes-D-CHD-Gly-Arg-AMC (Pefafluor FIXa10148) and H-D-Leu-PHG-Arg-AMC (Pefafluor FIXa3688), wherein cleavage is assessed by release of AMC, and the fluorogenic ester substrate, 4-methylumbelliferyl p'-guanidinobenzoate (MUGB), where cleavage is assessed by the release of 4-methylumbelliferone fluorophore (4-MU) (see e.g. Example 3). Molecules that enhance FIXa catalytic activity, such as ethylene glycol, can be employed in such assays (Sturzebecher et al. (1997) FEBS Lett. (412) 295-300).

Proteolytic activity of FIXa also can be assessed by measuring the conversion of factor X (FX) into activated factor X (FXa), such as described in Example 4, below. FIXa polypeptides, including the modified FIX polypeptides provided herein, can be incubated with FX polypeptides in the presence of FVIIIa, phospholipids vesicles (phosphatidylserine and/or phosphatidylcholine) and $Ca^{2+}$, and cleavage of FX to produce FXa can be assayed using a fluorogenic substrate, such as Spectrafluor FXa ($CH_3SO_2$-D-CHA-Gly-Arg-AMC), or a chromogenic substrate, such as S2222 or S2765 (Chromogenics AB, Molndal, Sweden), which are specifically cleaved by FXa.

d. Coagulation Activity

FIX polypeptides can be tested for coagulation activity by using assays well known in the art. For example, some of the assays include, but are not limited to, a two stage clotting assay (Liebman et al., (1985) PNAS 82:3879-3883); the prothrombin time assay (PT, which can measure TF-dependent activity of FIXa in the extrinsic pathway); assays which are modifications of the PT test; the activated partial thromboplastin time (aPTT, which can measure TF-independent activity of FIXa); activated clotting time (ACT); recalcified activated clotting time; the Lee-White Clotting time; or thromboelastography (TEG) (Pusateri et al. (2005) Critical Care 9:S15-S24). For example, coagulation activity of a modified FIX polypeptide can be determined by a PT-based assay where FIX is diluted in FIX-deficient plasma, and mixed with prothrombin time reagent (recombinant TF with phospholipids and calcium), such as that available as Innovin™ from Dade Behring. Clot formation is detected optically and time to clot is determined and compared against FIX-deficient plasma alone. In vivo coagulation assays in animal models, such as those described below, also can be performed to assess the coagulation activity of FIX polypeptides.

e. Binding to and/or Inhibition by Other Proteins and Molecules

Inhibition assays can be used to measure resistance of modified FIX polypeptides to FIX inhibitors, such as, for example, antithrombin III (AT-III), heparain, AT-III/heparin complex, p-aminobenzamidine, serine protease inhibitors, and FIX-specific antibodies. Assessment of inhibition to other inhibitors also can be tested and include, but are not limited to, other serine protease inhibitors. Inhibition can be assessed by incubation of the inhibitor with FIX polypeptides that have been preincubated with and/or without FVIIIa. The activity of FIX can then be measured using any one or more of the activity or coagulation assays described above, and inhibition by the inhibitor can be assessed by comparing the activity of FIX polypeptides incubated with the inhibitor, with the activity of FIX polypeptides that were not incubated with the inhibitor. For example, the inhibition of modified FIX polypeptides by AT-III/heparin can be assessed as described in Example 5, below. Inhibition of wild-type FIXa or FIXa variants by the AT-III/heparin complex is assessed by incubating AT-III/heparin with FIXa and the measuring the catalytic activity of FIXa towards a small molecule substrate, Mesyl-D-CHG-Gly-Arg-AMC (Pefafluor FIXa; Pentapharm). Such assays can be performed in the presence or absence of FVIIIa.

FIX polypeptides also can be tested for binding to other coagulation factors and inhibitors. For example, FIX direct and indirect interactions with cofactors, such as FVIIIa, substrates, such as FX and FIX, and inhibitors, such as antithrombin III and heparin, can be assessed using any binding assay known in the art, including, but not limited to, immunoprecipitation, column purification, non-reducing SDS-PAGE, BIAcore® assays, surface plasmon resonance (SPR), fluorescence resonance energy transfer (FRET), fluorescence polarization (FP), isothermal titration calorimetry (ITC), circular dichroism (CD), protein fragment complementation assays (PCA), Nuclear Magnetic Resonance (NMR) spectroscopy, light scattering, sedimentation equilibrium, small-zone gel filtration chromatography, gel retardation, Far-western blotting, fluorescence polarization, hydroxyl-radical protein footprinting, phage display, and various two-hybrid systems.

e. Phospholipid Affinity

Modified FIX polypeptide binding and/or affinity for phosphatidylserine (PS) and other phospholipids can be determined using assays well known in the art. Highly pure phospholipids (for example, known concentrations of bovine PS and egg phosphatidylcholine (PC), which are commercially available, such as from Sigma, in organic solvent can be used to prepare small unilamellar phospholipid vesicles. FIX polypeptide binding to these PS/PC vesicles can be determined by relative light scattering at 90° to the incident light. The intensity of the light scatter with PC/PS alone and with PC/PS/FIX is measured to determine the dissociation constant (Harvey et al., (2003) J. Biol. Chem. 278:8363-8369). Surface plasma resonance, such as on a BIAcore biosensor instrument, also can be used to measure the affinity of FIX polypeptides for phospholipid membranes (Sun et al., (2003) Blood 101:2277-2284).

2. Non-human Animal Models

Non-human animal models can be used to assess activity and stability of modified FIX polypeptides. For example, non-human animals can be used as models for a disease or condition. Non-human animals can be injected with disease and/or phenotype-inducing substances prior to administration of FIX variants to monitor the effects on disease progression. Genetic models also are useful. Animals, such as mice, can be generated which mimic a disease or condition by the overexpression, underexpression or knock-out of one or more genes. Such animals can be generated by transgenic animal production techniques well-known in the art or using naturally-occurring or induced mutant strains. Examples of useful non-human animal models of diseases associated with FIX include, but are not limited to, models of bleeding disorders, in particular hemophilia. These non-human animal models can be used to monitor activity of FIX variants compared to a wild type FIX polypeptide.

Animal models also can be used to monitor stability, half-life, clearance, and other pharmacokinetic and pharmacodynamic properties of modified FIX polypeptides. Such assays are useful for comparing modified FIX polypeptides and for calculating doses and dose regimens for further non-human animal and human trials. For example, a modified FIX polypeptide can be injected into the tail vein of mice. Blood samples are then taken at time-points after injection (such as minutes, hours and days afterwards) and then the pharmacokinetic and pharmacodynamic properties of the modified FIX polypeptides assessed, such as by monitoring the serum or plasma at specific time-points for FIXa activity and protein concentration by ELISA or radioimmunoassay (see e.g. Example 6). Blood samples also can be tested for coagulation activity in methods, such as the aPTT assay (see e.g. Example 6).

Modified FIX polypeptides can be tested for therapeutic effectiveness using animal models for hemophilia. In one non-limiting example, an animal model such as a mouse can be used. Mouse models of hemophilia are available in the art and include FIX deficient mice (such as those utilized in Example 7, below) and mice expressing mutant FIX polypeptides, and can be employed to test modified FIX polypeptides (Wang et al., (1997) PNAS 94:11563-11566; Lin et al., (1997) Blood 90:3962-3966; Kundu et al., (1998) Blood 92:168-174; Sabatino et al., (2004) Blood 104(9):2767-2774; and Jin et al., (2004) Blood 104:1733-1739; see also Example 7).

Other models of FIX deficiencies include hemophilic dogs that express defective FIX or that have been hepatectomized (Evans et al., (1989) PNAS 86:10095; Mauser et al., (1996) Blood 88:3451; and Kay et al., (1994) PNAS 91:2353-2357).

3. Clinical Assays

Many assays are available to assess activity of FIX for clinical use. Such assays can include assessment of coagulation, protein stability, and half-life in vivo and phenotypic assays. Phenotypic assays and assays to assess the therapeutic effect of FIX treatment include assessment of blood levels of FIX (such as measurement of serum FIX prior to administration and time-points following administrations including, after the first administration, immediately after last administration, and time-points in between, correcting for the body mass index (BMI)), phenotypic response to FIX treatment including amelioration of symptoms over time compared to subjects treated with an unmodified and/or wild type FIX or placebo. Examples of clinical assays to assess FIX activity can be found such as in Franchini et al., (2005) Thromb Haemost. 93(6):1027-1035; Shapiro et al., (2005) Blood 105 (2):518-525; and White et al., (1997) Thromb. Haemost. 78(1):261-265. Patients can be monitored regularly over a period of time for routine or repeated administrations, following administration in response to acute events, such as hemorrhage, trauma, or surgical procedures.

G. Formulation And Administration

Compositions for use in treatment of bleeding disorders are provided herein. Such compositions contain a therapeutically effective amount of a Factor IX polypeptide as described herein. Effective concentrations of FIX polypeptides or pharmaceutically acceptable derivatives thereof are mixed with a suitable pharmaceutical carrier or vehicle for systemic, topical or local administration. Compounds are included in an amount effective for treating the selected disorder. The concentration of active compound in the composition will depend on absorption, inactivation, excretion rates of the active compound, the dosage schedule, and amount administered as well as other factors known to those of skill in the art.

Pharmaceutical carriers or vehicles suitable for administration of the compounds provided herein include any such carriers known to those skilled in the art to be suitable for the particular mode of administration. Pharmaceutical compositions that include a therapeutically effective amount of a FIX polypeptide described herein also can be provided as a lyophilized powder that is reconstituted, such as with sterile water, immediately prior to administration.

1. Formulations

Pharmaceutical compositions containing a modified FIX can be formulated in any conventional manner by mixing a selected amount of the polypeptide with one or more physiologically acceptable carriers or excipients. Selection of the carrier or excipient is within the skill of the administering profession and can depend upon a number of parameters. These include, for example, the mode of administration (i.e., systemic, oral, nasal, pulmonary, local, topical, or any other mode) and disorder treated. The pharmaceutical compositions provided herein can be formulated for single dosage (direct) administration or for dilution or other modification. The concentrations of the compounds in the formulations are effective for delivery of an amount, upon administration, that is effective for the intended treatment. Typically, the compositions are formulated for single dosage administration. To formulate a composition, the weight fraction of a compound or mixture thereof is dissolved, suspended, dispersed, or otherwise mixed in a selected vehicle at an effective concentration such that the treated condition is relieved or ameliorated.

The modified FIX polypeptides provided herein can be formulated for administration to a subject as a two-chain FIXa protein. The modified FIX polypeptides can be activated by any method known in the art prior to formulation. For example, FIX can be activated by incubation with FXIa, such as FXIa immobilized on beads. Calcium can be included in these processes to ensure full activation and correct folding of the modified FIXa protein. The modified FIX polypeptides provided herein also can be formulated for administration as a single chain protein. The modified FIX polypeptides provided herein can be formulated such that the single-chain and two-chain forms are contained in the pharmaceutical composition, in any ratio by appropriate selection of the medium to eliminate or control autoactivation.

The compound can be suspended in micronized or other suitable form or can be derivatized to produce a more soluble active product. The form of the resulting mixture depends upon a number of factors, including the intended mode of administration and the solubility of the compound in the selected carrier or vehicle. The resulting mixtures are solutions, suspensions, emulsions and other such mixtures, and can be formulated as an non-aqueous or aqueous mixture, creams, gels, ointments, emulsions, solutions, elixirs, lotions, suspensions, tinctures, pastes, foams, aerosols, irrigations, sprays, suppositories, bandages, or any other formulation suitable for systemic, topical or local administration. For local internal administration, such as, intramuscular, parenteral or intra-articular administration, the polypeptides can be formulated as a solution suspension in an aqueous-based medium, such as isotonically buffered saline or are combined with a biocompatible support or bioadhesive intended for internal administration. The effective concentration is sufficient for ameliorating the targeted condition and can be empirically determined. To formulate a composition, the weight fraction of compound is dissolved, suspended, dispersed, or otherwise mixed in a selected vehicle at an effective concentration such that the targeted condition is relieved or ameliorated.

Generally, pharmaceutically acceptable compositions are prepared in view of approvals for a regulatory agency or other prepared in accordance with generally recognized pharmacopeia for use in animals and in humans. Pharmaceutical compositions can include carriers such as a diluent, adjuvant, excipient, or vehicle with which an isoform is administered. Such pharmaceutical carriers can be sterile liquids, such as water and oils, including those of petroleum, animal, vegetable or synthetic origin, such as peanut oil, soybean oil, mineral oil, and sesame oil. Water is a typical carrier when the pharmaceutical composition is administered intravenously. Saline solutions and aqueous dextrose and glycerol solutions also can be employed as liquid carriers, particularly for injectable solutions. Compositions can contain along with an active ingredient: a diluent such as lactose, sucrose, dicalcium phosphate, or carboxymethylcellulose; a lubricant, such as magnesium stearate, calcium stearate and talc; and a binder such as starch, natural gums, such as gum acacia, gelatin, glucose, molasses, polyinylpyrrolidine, celluloses and derivatives thereof, povidone, crospovidones and other such binders known to those of skill in the art. Suitable pharmaceutical excipients include starch, glucose, lactose, sucrose, gelatin, malt, rice, flour, chalk, silica gel, sodium stearate, glycerol monostearate, talc, sodium chloride, dried skim milk, glycerol, propylene, glycol, water, and ethanol. A composition, if desired, also can contain minor amounts of wetting or emulsifying agents, or pH buffering agents, for example, acetate, sodium citrate, cyclodextrine derivatives, sorbitan monolaurate, triethanolamine sodium acetate, triethanolamine oleate, and other such agents. These compositions can take the form of solutions, suspensions, emulsion, tablets, pills, capsules, powders, and sustained release formulations. Capsules and cartridges of e.g., gelatin for use in an inhaler or insufflator can be formulated containing a powder mix of a therapeutic compound and a suitable powder base such as lactose or starch. A composition can be formulated as a suppository, with traditional binders and carriers such as triglycerides. Oral formulation can include standard carriers such as pharmaceutical grades of mannitol, lactose, starch, magnesium stearate, sodium saccharine, cellulose, magnesium carbonate, and other such agents. Preparations for oral administration also can be suitably formulated with protease inhibitors, such as a Bowman-Birk inhibitor, a conjugated Bowman-Birk inhibitor, aprotinin and camostat. Examples of suitable pharmaceutical carriers are described in "Remington's Pharmaceutical Sciences" by E. W. Martin. Such compositions will contain a therapeutically effective amount of the compound, generally in purified form, together with a suitable amount of carrier so as to provide the form for proper administration to a subject or patient.

The formulation should suit the mode of administration. For example, the modified FIX can be formulated for parenteral administration by injection (e.g., by bolus injection or continuous infusion). The injectable compositions can take such forms as suspensions, solutions or emulsions in oily or aqueous vehicles. The sterile injectable preparation also can be a sterile injectable solution or suspension in a nontoxic parenterally-acceptable diluent or solvent, for example, as a solution in 1,4-butanediol. Sterile, fixed oils are conventionally employed as a solvent or suspending medium. For this purpose any bland fixed oil can be employed, including, but not limited to, synthetic mono- or diglycerides, fatty acids (including oleic acid), naturally occurring vegetable oils like sesame oil, coconut oil, peanut oil, cottonseed oil, and other oils, or synthetic fatty vehicles like ethyl oleate. Buffers, preservatives, antioxidants, and the suitable ingredients, can be incorporated as required, or, alternatively, can comprise the formulation.

The polypeptides can be formulated as the sole pharmaceutically active ingredient in the composition or can be combined with other active ingredients. The polypeptides can be targeted for delivery, such as by conjugation to a targeting agent, such as an antibody. Liposomal suspensions, including tissue-targeted liposomes, also can be suitable as pharmaceutically acceptable carriers. These can be prepared according to methods known to those skilled in the art. For example, liposome formulations can be prepared as described in U.S. Pat. No. 4,522,811. Liposomal delivery also can include slow release formulations, including pharmaceutical matrices such as collagen gels and liposomes modified with fibronectin (see, for example, Weiner et al., (1985) J. Pharm. Sci. 74(9): 922-5). The compositions provided herein further can contain one or more adjuvants that facilitate delivery, such as, but are not limited to, inert carriers, or colloidal dispersion systems. Representative and non-limiting examples of such inert carriers can be selected from water, isopropyl alcohol, gaseous fluorocarbons, ethyl alcohol, polyvinyl pyrrolidone, propylene glycol, a gel-producing material, stearyl alcohol, stearic acid, spermaceti, sorbitan monooleate, methylcellulose, as well as suitable combinations of two or more thereof.

The active compound is included in the pharmaceutically acceptable carrier in an amount sufficient to exert a therapeutically useful effect in the absence of undesirable side effects on the subject treated. The therapeutically effective concentration can be determined empirically by testing the compounds in known in vitro and in vivo systems, such as the assays provided herein.

a. Dosages

The precise amount or dose of the therapeutic agent administered depends on the particular FIX polypeptide, the route of administration, and other considerations, such as the severity of the disease and the weight and general state of the subject. Local administration of the therapeutic agent will typically require a smaller dosage than any mode of systemic administration, although the local concentration of the therapeutic agent can, in some cases, be higher following local administration than can be achieved with safety upon systemic administration. If necessary, a particular dosage and duration and treatment protocol can be empirically determined or extrapolated. For example, exemplary doses of recombinant and native FIX polypeptides can be used as a starting point to determine appropriate dosages. For example, a recombinant FIX (rFIXa) polypeptide that has been activated to rFIXa, BeneFIX® Factor IX has been administered to patients with hemophilia B for the treatment of hemorrhage as well as in prophylactic and surgical settings at various doses. Dosage and duration of treatment with recombinant FIX depends on the severity of the factor IX deficiency, the location and extent of bleeding, and the patient's clinical condition, age and recovery of factor IX. For example, patients with severe Hemophilia B (FIX activity of <1 IU/dL; 1% of normal activity (where 1 IU represents the activity of Factor IX in 1 mL of normal, pooled plasma) will require more transfused FIX than patients with moderate (FIX activity of 1-5 IU/dL; 1-5% of normal activity), or mild (FIX activity of >5-<40 IU/mL; >5-<40% of normal activity) hemophilia B. The initial estimated dose of BeneFIX® Factor IX can be determined using the following formula: Required units=body weight (kg)×desired factor IX increase (IU/dL or % of normal) x reciprocal of observed recovery (IU/kg per IU/dL). In clinical studies with adult and pediatric (<15 years) patients, one IU of BeneFIX per kilogram of body weight increased the circulating activity of factor IX as follows: Adults: 0.8±0.2 IU/dL [range 0.4 to 1.2 IU/dL]; Pediatric: 0.7±0.3 IU/dL [range 0.2 to 2.1 IU/dL].

Thus, for adult patients:

the number of Factor *IX* IU required(IU)=body weight (kg)×desired factor *IX* increase(% or IU/dL)×1.3 (IU/kg per IU/dL), and, for pediatric patients:

the number of Factor *IX* IU required(IU)=body weight (kg)×desired factor *IX* increase(% or IU/dL)×1.4 (IU/kg per IU/dL).

Table 11 sets forth the typical dosing used for various bleeding episodes.

TABLE 11

| Type of Hemorrhage | Circulating FIX activity required (% or IU/dL) | Dosing Interval (hours) | Duration of Therapy (days) |
|---|---|---|---|
| Minor: Uncomplicated hemarthroses, superficial muscle, or soft tissue | 20-30 | 12-24 | 1-2 |

TABLE 11-continued

| Type of Hemorrhage | Circulating FIX activity required (% or IU/dL) | Dosing Interval (hours) | Duration of Therapy (days) |
|---|---|---|---|
| Moderate: Intramuscle or soft tissue with dissection, mucous membranes, dental extractions, or hematuria | 25-50 | 12-24 | Treat until bleeding stops and healing begins, about 2 to 7 days |
| Major: Pharynx, retropharynx, retroperitoneum, CNS, surgery | 50-100 | 12-24 | 7-10 |

The modified FIX polypeptides provided herein can be effective at reduced dosage amounts and/or reduced frequencies compared to native recombinant FIX. For example, the modified FIX polypeptides provided herein can be administered at less frequent dosing intervals, such as 24 hours, 36 hours, 48 hours, 60 hours or more. In other examples, fewer doses of the modified FIX polypeptides can be administered. For example, the modified FIX polypeptides provided herein can be administered just once to achieve coagulation. In some embodiments, the dosages of modified FIX are reduced compared to native FIX. For example, the dosages can be less than or about 1 IU/kg, 2 IU/kg, 3 IU/kg, 4 IU/kg, 5 IU/kg, 6 IU/kg, 7 IU/kg, 8 IU/kg, 9 IU/kg, 10 IU/kg, 20 IU/kg, 30 IU/kg, 40 IU/kg or 50 IU/kg, 60 IU/kg, 70 IU/kg, 80 IU/kg, 90 IU/kg, or 100 IU/kg. The dose, duration of treatment and the interval between injections will vary with the severity of the bleed and the response of the patient to the treatment, and can be adjusted accordingly. Factors such as the level of activity and half-life of the modified FIX in comparison to the unmodified FIX can be taken into account when making dosage determinations. Particular dosages and regimens can be empirically determined. For example, a modified FIX polypeptide that exhibits a longer half-life than an unmodified FIX polypeptide can be administered at lower doses and/or less frequently than the unmodified FIX polypeptide. Similarly, the dosages required for therapeutic effect using a modified FIX polypeptide that displays increased coagulant activity compared with an unmodified FIX polypeptide can be reduced in frequency and amount. Particular dosages and regimens can be empirically determined by one of skill in the art.

b. Dosage Forms

Pharmaceutical therapeutically active compounds and derivatives thereof are typically formulated and administered in unit dosage forms or multiple dosage forms. Formulations can be provided for administration to humans and animals in dosage forms that include, but are not limited to, tablets, capsules, pills, powders, granules, sterile parenteral solutions or suspensions, oral solutions or suspensions, and oil water emulsions containing suitable quantities of the compounds or pharmaceutically acceptable derivatives thereof. Each unit dose contains a predetermined quantity of therapeutically active compound sufficient to produce the desired therapeutic effect, in association with the required pharmaceutical carrier, vehicle or diluent. Examples of unit dose forms include ampoules and syringes and individually packaged tablets or capsules. In some examples, the unit dose is provided as a lyophilized powder that is reconstituted prior to administration. For example, a FIX polypeptide can be provided as lyophilized powder that is reconstituted with a suitable solution to generate a single dose solution for injection. In some embodiments, the lyophilized powder can contain the FIX polypeptide and additional components, such as salts, such that reconstitution with sterile distilled water results in a FIX polypeptide in a buffered or saline solution. Unit dose forms can be administered in fractions or multiples thereof. A multiple dose form is a plurality of identical unit dosage forms packaged in a single container to be administered in segregated unit dose form. Examples of multiple dose forms include vials, bottles of tablets or capsules or bottles of pints or gallons. Hence, multiple dose form is a multiple of unit doses that are not segregated in packaging.

2. Administration of Modified Fix Polypeptides

The FIX polypeptides provided herein (i.e. active compounds) can be administered in vitro, ex vivo, or in vivo by contacting a mixture, such as a body fluid or other tissue sample, with a FIX polypeptide. For example, when administering a compound ex vivo, a body fluid or tissue sample from a subject can be contacted with the FIX polypeptides that are coated on a tube or filter, such as for example, a tube or filter in a bypass machine. When administering in vivo, the active compounds can be administered by any appropriate route, for example, orally, nasally, pulmonary, parenterally, intravenously, intradermally, subcutaneously, intraarticularly, intracisternally, intraocularly, intraventricularly, intrathecally, intramuscularly, intraperitoneally, intratracheally or topically, as well as by any combination of any two or more thereof, in liquid, semi-liquid or solid form and are formulated in a manner suitable for each route of administration. The modified FIX polypeptides can be administered once or more than once, such as twice, three times, four times, or any number of times that are required to achieve a therapeutic effect. Multiple administrations can be effected via any route or combination of routes, and can be administered hourly, every 2 hours, every three hours, every four hours or more.

The most suitable route for administration will vary depending upon the disease state to be treated, for example the location of the bleeding disorder. Generally, the FIX polypeptides will be administered by intravenous bolus injection, with an administration (infusing) time of approximately 2-5 minutes. In other examples, desirable blood levels of FIX can be maintained by a continuous infusion of the active agent as ascertained by plasma levels. It should be noted that the attending physician would know how to and when to terminate, interrupt or adjust therapy to lower dosage due to toxicity, or bone marrow, liver or kidney dysfunctions. Conversely, the attending physician would also know how to and when to adjust treatment to higher levels if the clinical response is not adequate (precluding toxic side effects). In other examples, the location of the bleeding disorder might indicate that the FIX formulation is administered via alternative routes. For example, local administration, including administration into the brain (e.g., intraventricularly) might be performed when the patient is experiencing bleeding in this region. Similarly, for treatment of bleeding in the joints, local administration by injection of the therapeutic agent into the joint (i.e., intraarticularly, intravenous or subcutaneous means) can be employed. In other examples, topical administration of the therapeutic agent to the skin, for example formulated as a cream, gel, or ointment, or administration to the lungs by inhalation or intratracheally, might be appropriate when the bleeding is localized to these areas.

The instances where the modified FIX polypeptides are be formulated as a depot preparation, the long-acting formulations can be administered by implantation (for example, subcutaneously or intramuscularly) or by intramuscular injection. Thus, for example, the therapeutic compounds can be formulated with suitable polymeric or hydrophobic materials (for example as an emulsion in an acceptable oil) or ion exchange resins, or as sparingly soluble derivatives, for example, as a sparingly soluble salt.

The compositions, if desired, can be presented in a package, in a kit or dispenser device, that can contain one or more unit dosage forms containing the active ingredient. The package, for example, contains metal or plastic foil, such as a blister pack. The pack or dispenser device can be accompanied by instructions for administration. The compositions containing the active agents can be packaged as articles of manufacture containing packaging material, an agent provided herein, and a label that indicates the disorder for which the agent is provided.

3. Administration of Nucleic Acids Encoding Modified FIX Polypeptides (Gene Therapy)

Also provided are compositions of nucleic acid molecules encoding the modified FIX polypeptides and expression vectors encoding them that are suitable for gene therapy. Rather than deliver the protein, nucleic acid can be administered in vivo, such as systemically or by other route, or ex vivo, such as by removal of cells, including lymphocytes, introduction of the nucleic therein, and reintroduction into the host or a compatible recipient.

Modified FIX polypeptides can be delivered to cells and tissues by expression of nucleic acid molecules. Modified FIX polypeptides can be administered as nucleic acid molecules encoding modified FIX polypeptides, including ex vivo techniques and direct in vivo expression. Nucleic acids can be delivered to cells and tissues by any method known to those of skill in the art. The isolated nucleic acid sequences can be incorporated into vectors for further manipulation. As used herein, vector (or plasmid) refers to discrete elements that are used to introduce heterologous DNA into cells for either expression or replication thereof. Selection and use of such vehicles are well within the skill of the artisan.

Methods for administering modified FIX polypeptides by expression of encoding nucleic acid molecules include administration of recombinant vectors. The vector can be designed to remain episomal, such as by inclusion of an origin of replication or can be designed to integrate into a chromosome in the cell. Modified FIX polypeptides also can be used in ex vivo gene expression therapy using non-viral vectors. For example, cells can be engineered to express a modified FIX polypeptide, such as by integrating a modified FIX polypeptide encoding-nucleic acid into a genomic location, either operatively linked to regulatory sequences or such that it is placed operatively linked to regulatory sequences in a genomic location. Such cells then can be administered locally or systemically to a subject, such as a patient in need of treatment.

Viral vectors, include, for example adenoviruses, adeno-associated viruses (AAV), poxviruses, herpes viruses, retroviruses and others designed for gene therapy can be employed. The vectors can remain episomal or can integrate into chromosomes of the treated subject. A modified FIX polypeptide can be expressed by a virus, which is administered to a subject in need of treatment. Viral vectors suitable for gene therapy include adenovirus, adeno-associated virus (AAV), retroviruses, lentiviruses, vaccinia viruses and others noted above. For example, adenovirus expression technology is well-known in the art and adenovirus production and administration methods also are well known. Adenovirus serotypes are available, for example, from the American Type Culture Collection (ATCC, Rockville, Md.). Adenovirus can be used ex vivo, for example, cells are isolated from a patient in need of treatment, and transduced with a modified FIX polypeptide-expressing adenovirus vector. After a suitable culturing period, the transduced cells are administered to a subject, locally and/or systemically. Alternatively, modified FIX polypeptide-expressing adenovirus particles are isolated and formulated in a pharmaceutically-acceptable carrier for delivery of a therapeutically effective amount to prevent, treat or ameliorate a disease or condition of a subject. Typically, adenovirus particles are delivered at a dose ranging from 1 particle to $10^{14}$ particles per kilogram subject weight, generally between $10^6$ or $10^8$ particles to $10^{12}$ particles per kilogram subject weight. In some situations it is desirable to provide a nucleic acid source with an agent that targets cells, such as an antibody specific for a cell surface membrane protein or a target cell, or a ligand for a receptor on a target cell. FIX also can be targeted for delivery into specific cell types. For example, adenoviral vectors encoding FIX polypeptides can be used for stable expression in nondividing cells, such as liver cells (Margaritis et al. (2004) J Clin Invest 113:1025-1031). In another example, viral or nonviral vectors encoding FIX polypeptides can be transduced into isolated cells for subsequent delivery. Additional cell types for expression and delivery of FIX might include, but are not limited to, fibroblasts and endothelial cells.

The nucleic acid molecules can be introduced into artificial chromosomes and other non-viral vectors. Artificial chromosomes, such as ACES (see, Lindenbaum et al., (2004) Nucleic Acids Res. 32(21):e172) can be engineered to encode and express the isoform. Briefly, mammalian artificial chromosomes (MACs) provide a means to introduce large payloads of genetic information into the cell in an autonomously replicating, non-integrating format. Unique among MACs, the mammalian satellite DNA-based Artificial Chromosome Expression (ACE) can be reproducibly generated de novo in cell lines of different species and readily purified from the host cells' chromosomes. Purified mammalian ACEs can then be re-introduced into a variety of recipient cell lines where they have been stably maintained for extended periods in the absence of selective pressure using an ACE System. Using this approach, specific loading of one or two gene targets has been achieved in LMTK(−) and CHO cells.

Another method for introducing nucleic acids encoding the modified FIX polypeptides is a two-step gene replacement technique in yeast, starting with a complete adenovirus genome (Ad2; Ketner et al. (1994) PNAS 91: 6186-6190) cloned in a Yeast Artificial Chromosome (YAC) and a plasmid containing adenovirus sequences to target a specific region in the YAC clone, an expression cassette for the gene of interest and a positive and negative selectable marker. YACs are of particular interest because they permit incorporation of larger genes. This approach can be used for construction of adenovirus-based vectors bearing nucleic acids encoding any of the described modified FIX polypeptides for gene transfer to mammalian cells or whole animals.

The nucleic acids can be encapsulated in a vehicle, such as a liposome, or introduced into a cells, such as a bacterial cell, particularly an attenuated bacterium or introduced into a viral vector. For example, when liposomes are employed, proteins that bind to a cell surface membrane protein associated with endocytosis can be used for targeting and/or to facilitate uptake, e.g. capsid proteins or fragments thereof tropic for a particular cell type, antibodies for proteins which undergo internalization in cycling, and proteins that target intracellular localization and enhance intracellular half-life.

For ex vivo and in vivo methods, nucleic acid molecules encoding the modified FIX polypeptide is introduced into cells that are from a suitable donor or the subject to be treated. Cells into which a nucleic acid can be introduced for purposes of therapy include, for example, any desired, available cell type appropriate for the disease or condition to be treated, including but not limited to epithelial cells, endothelial cells, keratinocytes, fibroblasts, muscle cells, hepatocytes; blood cells such as T lymphocytes, B lymphocytes, monocytes, macrophages, neutrophils, eosinophils, megakaryocytes, granulocytes; various stem or progenitor cells, in particular hematopoietic stem or progenitor cells, e.g., such as stem cells obtained from bone marrow, umbilical cord blood, peripheral blood, fetal liver, and other sources thereof.

For ex vivo treatment, cells from a donor compatible with the subject to be treated or the subject to be treated cells are removed, the nucleic acid is introduced into these isolated cells and the modified cells are administered to the subject. Treatment includes direct administration, such as, for example, encapsulated within porous membranes, which are implanted into the patient (see, e.g., U.S. Pat. Nos. 4,892,538 and 5,283,187 each of which is herein incorporated by reference in its entirety). Techniques suitable for the transfer of nucleic acid into mammalian cells in vitro include the use of liposomes and cationic lipids (e.g., DOTMA, DOPE and DC-Chol) electroporation, microinjection, cell fusion, DEAE-dextran, and calcium phosphate precipitation methods. Methods of DNA delivery can be used to express modified FIX polypeptides in vivo. Such methods include liposome delivery of nucleic acids and naked DNA delivery, including local and systemic delivery such as using electroporation, ultra-sound and calcium-phosphate delivery. Other techniques include microinjection, cell fusion, chromosome-mediated gene transfer, microcell-mediated gene transfer and spheroplast fusion.

In vivo expression of a modified FIX polypeptide can be linked to expression of additional molecules. For example, expression of a modified FIX polypeptide can be linked with expression of a cytotoxic product such as in an engineered virus or expressed in a cytotoxic virus. Such viruses can be targeted to a particular cell type that is a target for a therapeutic effect. The expressed modified FIX polypeptide can be used to enhance the cytotoxicity of the virus.

In vivo expression of a modified FIX polypeptide can include operatively linking a modified FIX polypeptide encoding nucleic acid molecule to specific regulatory sequences such as a cell-specific or tissue-specific promoter. Modified FIX polypeptides also can be expressed from vectors that specifically infect and/or replicate in target cell types and/or tissues. Inducible promoters can be use to selectively regulate modified FIX polypeptide expression. An exemplary regulatable expression system is the doxycycline-inducible gene expression system, which has been used to regulate recombinant FIX expression (Srour et al., (2003) Thromb. Haemost. 90(3):398-405).

Nucleic acid molecules, as naked nucleic acids or in vectors, artificial chromosomes, liposomes and other vehicles can be administered to the subject by systemic administration, topical, local and other routes of administration. When systemic and in vivo, the nucleic acid molecule or vehicle containing the nucleic acid molecule can be targeted to a cell.

Administration also can be direct, such as by administration of a vector or cells that typically targets a cell or tissue. For example, tumor cells and proliferating can be targeted cells for in vivo expression of modified FIX polypeptides. Cells used for in vivo expression of an modified FIX polypeptide also include cells autologous to the patient. Such cells can be removed from a patient, nucleic acids for expression of an modified FIX polypeptide introduced, and then administered to a patient such as by injection or engraftment.

H. Therapeutic Uses

The modified FIX polypeptides and nucleic acid molecules provided herein can be used for treatment of any condition for which unmodified FIX is employed. Thus, for example, the modified FIX polypeptides can be used as procoagulants for the treatment of bleeding disorders, including congenital and acquired bleeding disorders, such as hemophilia. Typically, therefore, the modified FIX polypeptides provided herein are procoagulants that are used in the treatment of bleeding disorders. In other particular examples, however, the modified FIX polypeptides can be used as anticoagulants. For example, a hyperglycosylated modified FIX polypeptide that also contains one or more modifications that result in a lack of catalytic activity for it's substrate, FX, can be used as an anticoagulant to treat thrombotic disorders.

The modified FIX polypeptides provided herein have therapeutic activity alone or in combination with other agents. The modified polypeptides provided herein are designed to retain therapeutic activity but exhibit modified properties, such as improved pharmacokinetic and pharmacodynamic properties, increased resistance to inhibitors and/or improved catalytic activity. Such modified properties and activities, for example, can improve the therapeutic effectiveness of the polypeptides. The modified FIX polypeptides and encoding nucleic acid molecules provided herein can be used for treatment of any condition for which unmodified FIX is employed. This section provides exemplary uses of and administration methods. These described therapies are exemplary only and do not limit the applications of modified FIX polypeptides.

The modified FIX polypeptides provided herein can be used in various therapeutic as well as diagnostic methods in which FIX is employed. Such methods include, but are not limited to, methods of treatment of physiological and medical conditions described and listed below. Modified FIX polypeptides provided herein can exhibit improvement of in vivo activities and therapeutic effects compared to wild-type FIX, including lower dosage to achieve the same effect, a more sustained therapeutic effect and other improvements in administration and treatment.

The modified FIX polypeptides described herein can exhibit improved pharmacokinetic and pharmacodynamic properties, increased catalytic activity, increased resistance to inhibitors and/or increased coagulant activity compared to an unmodified FIX polypeptide. Such polypeptides can be used as procoagulants for the treatment of, for example, bleeding disorders, including congenital bleeding disorders and acquired bleeding disorders. In some examples, the modified FIX polypeptides provided herein that have non-native glycosylation sites also contain modifications that result in a modified FIX polypeptide that inhibits coagulation, such that the modified FIX polypeptide is an anti-coagulant and can be used to treat, for example, thrombotic diseases and disorders. The modified FIX polypeptides provided herein can be used to deliver longer-lasting, more stable therapies. Examples of therapeutic improvements using modified FIX polypeptides include, but are not limited to, lower dosages, fewer and/or less frequent administrations, decreased side effects and increased therapeutic effects.

Typically, the modified FIX polypeptides provided herein are procoagulants and can be used to treat bleeding disorders, including congenital bleeding disorders and acquired bleeding disorders. In particular examples, modified FIX polypeptides are intended for use in therapeutic methods in which other modified and unmodified FIX polypeptides have been used for treatment. Exemplary diseases and disorders that can be treated with the modified FIX polypeptides, alone or in combination with other agents, including other procoagulants, include, but are not limited to, blood coagulation disorders, hematologic diseases, hemorrhagic disorders, hemophilias, in particular hemophilia B, and acquired blood disorders, including bleeding associated with trauma and surgery. In some embodiments, the bleedings to be treated by FIX polypeptides occur in organs such as the brain, inner ear region, eyes, liver, lung, tumor tissue, gastrointestinal tract. In other embodiments, the bleeding is diffuse, such as in hemorrhagic gastritis and profuse uterine bleeding.

Patients with bleeding disorders, such as hemophilia, are often at risk for hemorrhage and excessive bleeding during surgery, including dental extraction, or trauma. Such patients often have acute haemarthroses (bleedings in joints), chronic hemophilic arthropathy, haematomas, (such as, muscular, retroperitoneal, sublingual and retropharyngeal), bleedings in other tissue, haematuria (bleeding from the renal tract), cerebral hemorrhage, and gastrointestinal bleedings (such as, UGI bleeds), that can be treated with modified FIX polypeptides. Thus, inc some examples, the modified FIX polypeptides are used to treat bleeding episodes due to trauma or surgery, or lowered count or activity of platelets, in a subject. Exemplary methods for patients undergoing surgery include treatments to prevent hemorrhage and treatments before, during, or after surgeries.

Although typically the modified FIX polypeptides provided herein exhibit improved coagulant activity compared to a modified FIX polypeptide, in some examples, the modified FIX polypeptides provided herein can contain one or more non-native glycosylation sites and also lack functional peptidase activity. Such modified FIX polypeptides can be used in therapeutic methods to inhibit blood coagulation (see e.g., U.S. Pat. No. 6,315,995). Modified FIX polypeptides that inhibit blood coagulation can be used in anticoagulant methods of treatment for ischemic and thrombotic disorders. In surgical patients with an increased risk of excessive clotting, such as patients with deep vein thrombosis (DVT) or superficial vein thrombosis (SVT), the modified FIX polypeptides provided herein that are anticoagulants can be administered to prevent excessive clotting in surgeries. In some cases treatment is performed with FIX alone. In some cases, FIX is administered in conjunction with additional anticoagulation factors as required by the condition or disease to be treated.

Treatment of diseases and conditions with modified FIX polypeptides can be effected by any suitable route of administration using suitable formulations as described herein including, but not limited to, injection, pulmonary, oral and transdermal administration. If necessary, a particular dosage and duration and treatment protocol can be empirically determined or extrapolated. For example, exemplary doses of recombinant and native FIX polypeptides, such as recommended dosages of BeneFIX® Coagulation Factor LX (Recombinant) as described above, can be used as a starting point to determine appropriate dosages. Modified FIX polypeptides that are hyperglycosylated and have an increased half-life in vivo, or that have increased resistance to inhibitors, or have increased catalytic activity, can be effective at reduced dosage amounts and/or frequencies. Dosages and dosage regimens for unmodified FIX polypeptides can be used as guidance for determining dosages for the modified FIX polypeptides provided herein. Factors such as the half-life and level of activity of the modified FIX in comparison to the unmodified FIX can be used in making such determinations. Particular dosages and regimens can be empirically determined Dosage levels and regimens can be determined based upon known dosages and regimens, and, if necessary can be extrapolated based upon the changes in properties of the modified polypeptides and/or can be determined empirically based on a variety of factors. Such factors include body weight of the individual, general health, age, the activity of the specific compound employed, sex, diet, time of administration, rate of excretion, drug combination, the severity and course of the disease, and the patient's disposition to the disease and the judgment of the treating physician. The active ingredient, the polypeptide, typically is combined with a pharmaceutically effective carrier. The amount of active ingredient that can be combined with the carrier materials to produce a single dosage form or multi-dosage form can vary depending upon the host treated and the particular mode of administration.

The effect of the FIX polypeptides on the clotting time of blood can be monitored using any of the clotting tests known in the art including, but not limited to, whole blood partial thromboplastin time (PTT), the activated partial thromboplastin time (OTT), the activated clotting time (ACT), the recalcified activated clotting time, or the Lee-White Clotting time.

Upon improvement of a patient's condition, a maintenance dose of a compound or compositions can be administered, if necessary; and the dosage, the dosage form, or frequency of administration, or a combination thereof can be modified. In some cases, a subject can require intermittent treatment on a long-term basis upon any recurrence of disease symptoms or based upon scheduled dosages. In other cases, additional administrations can be required in response to acute events such as hemorrhage, trauma, or surgical procedures.

Hemophilia

Hemophilia is a bleeding disorder that is caused by a deficiency in one or more blood coagulation factors. It is characterized by a decreased ability to form blood clots at sites of tissue damage. Congenital X-linked hemophilias include hemophilia A and hemophilia B, or Christmas disease, which are caused by deficiencies in FVIII and FIX, respectively. Hemophilia A occurs at a rate of 1 out of 10,0000 males, while hemophilia B occurs in 1 out of 50,000 males.

Patients with hemophilia suffer from recurring joint and muscle bleeds, which can be spontaneous or in response to trauma. The bleeding can cause severe acute pain, restrict movement, and lead to secondary complications including synovial hypertrophy. Furthermore, the recurring bleeding in the joints can cause chronic synovitis, which can cause joint damage, destroying synovium, cartilage, and bone.

The modified FIX polypeptides provided herein and the nucleic acids encoding the modified FIX polypeptides provided herein can be used in therapies for hemophilia, including treatment of bleeding conditions associated with hemophilia. The modified FIX polypeptides provided herein can be used, for example, to control or prevent spontaneous bleeding episodes or to control or prevent bleeding in response to trauma or surgical procedures.

The modified FIX polypeptides herein can exhibit improved pharmacokinetic and pharmacodynamic properties, such as improved serum half-life, increased resistance to inhibitors, increased catalytic activity, and/or increased coagulant activity. Thus, modified FIX polypeptides can be used to deliver longer lasting or otherwise improved therapies for hemophilia. Examples of therapeutic improvements using modified FIX polypeptides include for example, but are not limited to, lower dosages, fewer and/or less frequent administrations, decreased side effects, and increased therapeutic effects.

Modified FIX polypeptides can be tested for therapeutic effectiveness, for example, by using animal models. For example FIX-deficient mice, or any other known disease model for hemophilia, can be treated with modified FIX polypeptides. Progression of disease symptoms and phenotypes is monitored to assess the effects of the modified FIX polypeptides. Modified FIX polypeptides also can be administered to animal models as well as subjects such as in clinical trials to assess in vivo effectiveness in comparison to placebo controls and/or controls using unmodified FIX.

a. Hemophilia B

Hemophilia B can be effectively managed with administration of FIX therapeutics. Patients with severe Hemophilia B have an FIX activity of <1 IU/dL (1% of normal activity), patients with moderate Hemophilia B have a FIX activity of 1-5 IU/dL (1-5% of normal activity) and patients with mild hemophilia B have a FIX activity of >5-<40 IU/mL (>5-<40% of normal activity). With proper prophylactic replacement therapy and/or treatment of particular bleeding episodes with an appropriate amount of FIX, patients often can achieve normal life span. Administration of FIX can aid in controlling bleeding during surgery, trauma, during dental extraction, or to alleviate bleeding associated with hemarthroses, hematuria, mucocutaneous bleeding, such as epistaxis or gastrointestinal tract bleeding, cystic lesions in subperiosteal bone or soft tissue, or hematomas, which cause neurological complications such as intracranial bleeding, spinal canal bleeding. Death in patients with hemophilia is often the result of bleeding in the central nervous system. Other serious complications in hemophilic patients include development of inhibitors to coagulation factor therapeutics and disease.

The most frequent alterations in the FIX gene in hemophilia B patients are point mutations, in particular missense mutations. Most of the identified FIX mutations occur in amino acid residues in the coding region of the FIX gene, often affecting evolutionarily conserved amino acids. The severity of the hemophilia depends upon the nature of the mutation. Mutations in the coding region can affect a number of different properties or activities of the FIX polypeptide including alteration of protease activity, cofactor binding, signal peptide or propeptide cleavage, post-translational modifications, and inhibition of cleavage of FIX into its activated form. Other types of point mutations include nonsense mutations that produce an unstable truncated FIX polypeptide, and frameshift mutations (small deletions and insertions) that result in a terminally aberrant FIX molecule. In addition, FIX point mutations can be found in the promoter region, which can disrupt the recognition sequences for several specific gene regulatory proteins, resulting in reduced transcription of coagulation factor IX. Decreased FIX as a result of transcriptional abnormalities is called Hemophilia B Leyden. An exemplary mutation in the promoter region includes disruption of the HNF-4 binding site, which affect regulation of FIX transcription by the androgen receptor. The severity of this type of hemophilia is governed by the levels of androgen in the blood, which increase during puberty and partially alleviate the FIX transcriptional deficiency (Kurachi et al. (1995)). Other missense nucleotide changes affect the processing of factor IX primary RNA transcript. For example, some mutations occur at evolutionarily conserved donor-splice (GT), and acceptor-splice (AG) consensus sequences, which can create cryptic splice junctions and disrupt assembly of spliceosomes. Some severe cases of hemophilia (approximately 10%) present with large deletions in the FDC gene.

Treatment of FIX deficiency, and thus hemophilia B, most often involves administration of FIX, including recombinant forms of FIX, purified plasma FIX preparations or purified plasma concentrates. Thus, similarly, the modified FIX polypeptides herein, and nucleic acids encoding modified FIX polypeptides, can be used for treatment of hemophilia B. The modified FIX polypeptides herein can exhibit improved pharmacokinetic and pharmacodynamic properties, such as improved serum half-life, increased resistance to inhibitors, increased catalytic activity, and/or increased coagulant activity. Thus, modified FIX polypeptides can be used to deliver improved therapies for hemophilia. Examples of therapeutic improvements using modified FIX polypeptides include for example, but are not limited to, lower dosages, fewer and/or less frequent administrations, decreased side effects, and increased therapeutic effects.

b. Hemophilia A

Hemophilia A, which accounts for approximately 85% of all cases of hemophilia, results from mutations(s) in the factor VIII gene on the X chromosome, leading to a deficiency or dysfunction of the FVIII protein. Typically, treatment of hemophilia A with native FIX polypeptides, including recombinant FIX polypeptides such as BeneFIX® Coagulation Factor IX (Recombinant), or plasma-purified FIX polypeptides is not recommended because the native FIX polypeptide requires FVIIIa for catalytic activity to effect coagulation. Modified FIX polypeptides, however, such as those described herein, that contain one or more modifications to increase the FIX intrinsic activity, can be used in the treatment of hemophilia B. Such polypeptides have FVIII-independent activity, and thus can function as a coagulant in hemophilia A patients. For example, the modified FIX polypeptides described above, such as those that contain one or more modifications to introduce or eliminate one or more non-native glycosylation sites, and/or one or more modifications to increase resistance to AT-III and/or heparin, and that also contain and one or more modifications to increase activity of the modified FIX polypeptide in the absence of FVIIIa, can be used to treat bleeding episodes in patients with Hemophilia A.

Modifications to increase intrinsic activity of a FIX polypeptide such that it can act in a FVIIIa-independent manner are described above and elsewhere (see e.g. Hopfner et al., (1997) *EMBO J.* 16:6626-6635; Kolkman et al., (2000) *Biochem.* 39:7398-7405; Sichler et al., (2003) *J. Biol. Chem.* 278:4121-4126; Begbie et al., (2005) *Thromb Haemost.* 94(6):1138-47, U.S. Pat. No. 6,531,298 and U.S. Patent Publication Nos. 20080167219 and 20080214461), and include, but are not limited to, amino acid replacements V86A, V86N, V86D, V86E, V86Q, V86G, V86H, V86I, V86L, V86M, V86F, V86S, V86T, V86W, V86Y, Y259F, A261K, K265T, E277V, E277A, E277N, E277D, E277Q, E277G, E277H, E277I, E277L, E277M, E277F, E277S, E277T, E277W, E277Y, R338A, R338V, R338I, R338F, R338W, R338S, R338T, Y345F, I383V and E388G. For example, a modified FIX polypeptide provided herein can contain the amino acid substitutions Y259F/K265T, Y259F/K265T/Y345F, Y259F/A261K/K265T/Y345F, Y259F/K265T/Y345F/I383V/E388G or Y259F/A261K/K265T/Y345F/I383V/E388G and can exhibit increased intrinsic activity. Such modified FIX polypeptides can be used, therefore, in the treatment of Hemophilia A.

J. Combination Therapies

Any of the modified FIX polypeptides, and nucleic acid molecules encoding modified FIX polypeptides described herein can be administered in combination with, prior to, intermittently with, or subsequent to, other therapeutic agents or procedures including, but not limited to, other biologics, small molecule compounds and surgery. For any disease or condition, including all those exemplified above, for FIX is indicated or has been used and for which other agents and treatments are available, FIX can be used in combination therewith. Hence, the modified FIX polypeptides provided herein similarly can be used. Depending on the disease or condition to be treated, exemplary combinations include, but are not limited to combination with other plasma purified or recombinant coagulation factors, procoagulants, anticoagulants, anti-coagulation antibodies, glycosaminoglycans, heparins, heparinoids, heparin derivatives, heparin-like drugs, coumarins, such as warfarin and coumarin derivatives. Additional procoagulants that can be used in combination therapies with modified FIX polypeptides provided herein that have procoagulant properties include, but are not limited to, vitamin K, vitamin K derivatives, other coagulation factors, and protein C inhibitors. Additional anticoagulants that can be used in combination therapies with modified FIX polypeptides provided herein that have anticoagulant properties include, but are not limited to, β2 adrenoreceptor antagonists, neuropeptide V2 antagonists, prostacyclin analogs, thromboxane synthase inhibitors, calcium agonists, elastase inhibitors, non-steroidal anti-inflammatory molecules, thrombin inhibitors, lipoxygenase inhibitors, FVIIa inhibitors, FXa inhibitors, phosphodiesterase III inhibitors, fibrinogen, vitamin K antagonists, and glucoprotein IIb/IIIa antagonists.

K. Articles Of Manufacture And Kits

Pharmaceutical compounds of modified FIX polypeptides for nucleic acids encoding modified FIX polypeptides, or a derivative or a biologically active portion thereof can be packaged as articles of manufacture containing packaging material, a pharmaceutical composition which is effective for treating a FIX-mediated disease or disorder, and a label that indicates that modified FIX polypeptide or nucleic acid molecule is to be used for treating a FIX-mediated disease or disorder.

The articles of manufacture provided herein contain packaging materials. Packaging materials for use in packaging pharmaceutical products are well known to those of skill in the art. See, for example, U.S. Pat. Nos. 5,323,907, 5,033,252 and 5,052,558, each of which is incorporated herein in its entirety. Examples of pharmaceutical packaging materials include, but are not limited to, blister packs, bottles, tubes, inhalers, pumps, bags, vials, containers, syringes, bottles, and any packaging material suitable for a selected formulation and intended mode of administration and treatment. A wide array of formulations of the compounds and compositions provided herein are contemplated as are a variety of treatments for any FIX-mediated disease or disorder.

Modified FIX polypeptides and nucleic acid molecules also can be provided as kits. Kits can include a pharmaceutical composition described herein and an item for administration. For example a modified FIX can be supplied with a device for administration, such as a syringe, an inhaler, a dosage cup, a dropper, or an applicator. The kit can, optionally, include instructions for application including dosages, dosing regimens and instructions for modes of administration. Kits also can include a pharmaceutical composition described herein and an item for diagnosis. For example, such kits can include an item for measuring the concentration, amount or activity of FIX or a FIX regulated system of a subject.

The following examples are included for illustrative purposes only and are not intended to limit the scope of the invention.

L. EXAMPLES

Example 1

Cloning and expression of Factor IX polypeptides

A. Cloning of FIX Gene

The nucleic acid encoding the 461 amino acid human FIX precursor polypeptide (P00740; set forth in SEQ ID NO:1) was cloned into the mammalian expression vector, pFUSE-hIgG1-Fc2 (abbreviated here as pFUSE) (InvivoGen; SEQ ID NO:23), which contains a composite promoter, hEF1-HTLV, comprising the Elongation Factor-1α (EF-1α) core promoter and the R segment and part of the U5 sequence (R-U5') of the human T-Cell Leukemia Virus (HTLV) Type 1 Long Terminal Repeat. The In-Fusion CF Dry-Down PCR Cloning Kit (Clontech) was used according to the conditions specified by the supplier.

For the In-Fusion process, plasmid pFUSE without the human immunoglobulin 1 (hIgG1) Fc portion was linearized using polymerase chain reaction (PCR) with the pFUSE-Acc-F1 forward primer: GTGCTAGCTGGCCAGACAT-GATAAG (SEQ ID NO:24) and the pFUSE-Acc-R3 reverse primer: CATGGTGGCCCTCCTTCGCCGGTGATC (SEQ ID NO:25), and was used as Acceptor DNA. The full-length coding sequence of FIX was amplified by PCR using human FIX cDNA (Origene) as template with the FIX-wtsp-Invivo-F1 forward primer: CGAAGGAGGGCCACC<u>ATG</u>CAGCGCGTGAACATGATC (SEQ ID NO:26) and FIX-Invivo-R1 reverse primer: TGTCTGGCCAGCTAG-CAC<u>TTA</u>AGTGAGCTTGTTTTTTCC (SEQ ID NO:27). For two FIX Donor amplification primer sequences set forth above, both FIX 'ATG' start and complementary sequence of 'TAA' stop codons are underlined in the forward and reverse primer sequences, respectively. The 18-nt long homology regions, a non-annealing 5' primer tail for In-Fusion, are shown in bold. Standard PCR reaction and thermocycling conditions were used in conjunction with the Fusion High-Fidelity Master Mix Kit (New England Biolabs), as recommended by the manufacturer. Both Acceptor and Donor PCR products were then digested with DpnI restriction enzyme to remove *E. coli*-derived dam methylated PCR template backgrounds. They were then mixed together, and the In-Fusion reaction was run using conditions specified by the supplier. The reaction mix was transformed into *E. coli* XL1Blue supercompetent cells (Stratagene). Colonies were selected on 2xYT agar plates supplemented with 25 ppm Zeocin (InvivoGen). Plasmid DNA was isolated from selected clones, and sequenced to verify correct cloning.

B. Generation of FIX Variants

FIX variants were generated using the QuikChange Lightning Site-Directed Mutagenesis Kit (Stratagene) according to manufacturer's instructions with specifically designed oligonucleotides that served as primers to incorporate designed mutations into the newly synthesized DNA. Complementary primers that include the desired mutations were extended during cycling using purified, double-stranded super-coiled pFUSE plasmid DNA that contained the cloned FIX cDNA sequence as a template. Extension of the primers resulted in incorporation of the mutations of interest into the newly synthesized strands, and resulted in a mutated plasmid with staggered nicks. Following amplification, the mutagenesis product was digested with DpnI restriction enzyme to remove dam methylated parental strands of the *E. coli*-derived pFUSE DNA. The DNA was then transformed into *E. coli* XL1Blue supercompetent cells (Stratagene) followed by selection on 2xYT agar plates supplemented with 25 ppm Zeocin (InvivoGen). Plasmid DNA was isolated from selected clones, and sequenced to verify for incorporation of mutation(s) at the desired location(s) on the FIX gene.

The nucleotide sequence of one of the oligonucleotides from each complementary primer pair used to generate the FIX variants is provided in Table 12. The nucleotide triplet sequences that encode a substituted amino acid are shown in uppercase. For example, to generate a FIX variant containing the substitutions A103N/N105S (A[103]N/N[105]S by chymotrypsin numbering; SEQ ID NO:77), the A103N/N105S-

Forward primer, and a primer that is complementary to A103N/N105S-Forward, were used to replace a 9-bp 'GCTgatAAC' wild-type sequence with a 9-bp 'AATgatAGC' mutant sequence (changed nucleotide triplets are denoted by upper case).

Table 12 below sets forth the oligonucleotide primers used for FIX mutagenesis. The mutant triplets are shown in upper case, and primer names correspond to the mutation, by chymotrypsin numbering, produced as a result of the mutagenesis using the primer.

TABLE 12

| Primer Name | Primer Sequence (5' to 3') | SEQ ID NO. |
| --- | --- | --- |
| F9-A[103]N/N[105]S-For | gtaaaaatagtAATgatAGCaaggtggtttg | 28 |
| F9-D[104]N/K[106]S-For | gtaaaaatagtgctAATaacAGTgtggtttgctcctgtactg | 29 |
| F9-K[106]N/V[108]S-For | gtgctgataacAATgtgAGTtgctcctgtactg | 30 |
| F9-D[85]N-For | gaactgtgaattaAATgtaacatgtaac | 31 |
| F9-T[148]A-For | ctcacccgtgctgagGCTgttttcctgatgtg | 32 |
| F9-D39N/F41T-For | gaatggtaaagttAATgcaACCtgtggaggctctatc | 33 |
| F9-K63N-For | gaaactggtgttAACattacagttgtcgc | 34 |
| F9-I86S-For | gcgaaatgtgAGTcgaattattcctc | 35 |
| F9-A95bS-For | caactacaatgcaAGTattaataagtacaac | 36 |
| F9-K243N-For | aaggaaaaaacaAATctcacttaagtgctagctg | 37 |
| F9-E240N-For | ctggattaagAATaaaacaaagctc | 38 |
| F9-E74N-For | caggtgaacataatattAACgagacagaacatacag | 39 |
| F9-T76N/H78S-For | gaacataatattgaggagAACgaaAGTacagagcaaaag | 40 |
| F9-K82N/N84S-For | cagaacatacagagcaaAATcgaTCTgtgattcgaattattc | 41 |
| F9-L153N-For | gggagatcagctAATgttcttcagtac | 42 |
| F9-F145N/H147S-For | ctggggaagagtcAACTCCaaagggagatcag | 43 |
| F9-K222N/K224S-For | gagtgtgcaatgAACggcTCAtatggaatatatac | 44 |
| F9-S151N/L153S-For | cttccacaaagggagaAATgctTCAgttcttca | 45 |
| F9-N95S-For | cctcaccacaactacAGTgcagctattaataagtacaacc | 46 |
| F9-Y117N-For | cttagtgctaaacagcAACgttacacctatttgc | 47 |
| F9-G149N-For | ggaagagtcttccacaaaAACagatcagctttagttc | 48 |
| F9-R150N/A152S-For | gtcttccacaaagggAACtcaTCTttagttcttcagtac | 49 |
| F9-R150A-For | gtcttccacaaagggGCAtcagctttagttcttcag | 50 |
| F9-R150E-For | gtcttccacaaagggGAAtcagctttagttcttcag | 51 |
| F9-R150Y-For | gtcttccacaaagggTACtcagctttagttcttcag | 52 |
| F9-R143Q-For | gtaagtggctggggaCAAgtcttccacaaaggg | 53 |
| F9-R143A-For | gtaagtggctggggaGCAgtcttccacaaaggg | 54 |
| F9-R143Y-For | gtaagtggctggggaTACgtcttccacaaaggg | 55 |
| F9-R143L-For | gtaagtggctggggaCTGgtcttccacaaaggg | 56 |
| F9-V38M-For | gttttgaatggtaaaATGgatgcattctgtggaggc | 57 |
| F9-V38Y-For | gttttgaatggtaaaTACgatgcattctgtggaggc | 58 |
| F9-D39M-For | gttttgaatggtaaagttATGgcattctgtggaggc | 59 |
| F9-D39Y-For | gttttgaatggtaaagttTACgcattctgtggaggc | 60 |

TABLE 12-continued

| Primer Name | Primer Sequence (5' to 3') | SEQ ID NO. |
|---|---|---|
| F9-A40M-For | gttttgaatggtaaagttgatATGttctgtggaggctctatc | 61 |
| F9-A40Y-For | gttttgaatggtaaagttgatTACttctgtggaggctctatc | 62 |
| F9-R233A/K230A-For | caaatatggaatatataccGCAgtatccGCAtatgtcaactggattaag | 63 |
| F9-R233E/K230E-For | caaatatggaatatataccGAAgtatccGAAtatgtcaactggattaag | 64 |
| F9-R233A-For | gaatatataccaaggtatccGCAtatgtcaactggattaag | 65 |
| F9-R233E-For | gaatatataccaaggtatccGAAtatgtcaactggattaag | 66 |
| F9-K230A-For | caaatatggaatatataccGCAgtatcccggtatgtc | 67 |
| F9-K230E-For | caaatatggaatatataccGAAgtatcccggtatgtc | 68 |
| F9-K126E-For | cctatttgcattgctgacGAAgaatacacgaacatc | 69 |
| F9-K126A-For | cctatttgcattgctgacGCAgaatacacgaacatc | 70 |
| F9-R165A-For | gttccacttgttgacGCAgccacatgtcttcgatct | 71 |
| F9-R165E-For | gttccacttgttgacGAAgccacatgtcttcgatct | 72 |
| F9-R170A-For | cgagccacatgtcttGCAtctacaaagttcacc | 73 |
| F9-R170E-For | cgagccacatgtcttGAAtctacaaagttcacc | 74 |
| F9-D[64]N-For | ggcggcagttgcaagAACgacattaattcctatG | 273 |
| F9-D[64]A-For | ggcggcagttgcaagGCTgacattaattcctatG | 274 |
| F9-N[157]Q-For | cctgatgtggactatgtaCAGtctactgaagctgaaacc | 275 |
| F9-N[157]D-For | cctgatgtggactatgtaGACtctactgaagctgaaacc | 276 |
| F9-N[167]Q-For | gaaaccattttggatCAGatcactcaaagcacc | 277 |
| F9-N[167]D-For | gaaaccattttggatGACatcactcaaagcacc | 278 |
| F9-S[61]A-For | ccatgtttaaatggcggcGCTtgcaaggatgacattaattcc | 279 |
| F9-S[53]A-For | gatggagatcagtgtgagGCTaatccatgtttaaatggc | 280 |
| F9-T[159]A-For | gtggactatgtaaattctGCTgaagctgaaaccattttg | 281 |
| F9-T[169]A-For | CattttggataacatcGCTcaaagcacccaatcatttaatgac | 282 |
| F9-T[172]A-For | gataacatcactcaaagcGCTcaatcatttaatgac | 283 |
| F9-T[179]A-For | caatcatttaatgacttcGCTcgggttgttggtggagaaG | 284 |
| F9-Y[155]F-For | gttttttcctgatgtggacTTCgtaaattctactgaagctG | 285 |
| F9-Y[155]H-For | gttttttcctgatgtggacCACgtaaattctactgaagctG | 286 |
| F9-Y[155]Q-For | gttttttcctgatgtggacCAGgtaaattctactgaagctG | 287 |
| F9-S[158]A-For | gtggactatgtaaatGCTactgaagctgaaacc | 288 |
| F9-S[158]D-For | gtggactatgtaaatGACactgaagctgaaacc | 289 |
| F9-S[158]E-For | gtggactatgtaaatGAGactgaagctgaaacc | 290 |
| F9-R165S-For | gttccacttgttgacAGCgccacatgtcttcgatct | 291 |
| F9-R170L-For | cgagccacatgtcttCTGtctacaaagttcacc | 292 |
| F9-K148N-For | ggaagagtcttccacAACgggagatcagctttaG | 293 |
| F9-K148A-For | ggaagagtcttccacGCTgggagatcagctttaG | 294 |
| F9-K148E-For | ggaagagtcttccacGAGgggagatcagctttaG | 295 |

TABLE 12-continued

| Primer Name | Primer Sequence (5' to 3') | SEQ ID NO. |
|---|---|---|
| F9-K148S-For | ggaagagtcttccacAGCgggagatcagctttaG | 296 |
| F9-K148M-For | ggaagagtcttccacATGgggagatcagctttaG | 297 |
| F9-E74S-For | ggtgaacataatattAGCgagacagaacatacaG | 298 |
| F9-E74A-For | ggtgaacataatattGCTgagacagaacatacaG | 299 |
| F9-E74R-For | ggtgaacataatattAGGgagacagaacatacaG | 300 |
| F9-E74K-For | ggtgaacataatattAAGgagacagaacatacaG | 301 |
| F9-H92F-For-Corr | cgaattattcctcacTTCaactacaatgcaGC | 302 |
| F9-H92Y-For-Corr | cgaattattcctcacTACaactacaatgcaGC | 303 |
| F9-H92E-For-Corr | cgaattattcctcacGAAaactacaatgcaGC | 304 |
| F9-H92S-For-Corr | cgaattattcctcacAGCaactacaatgcaGC | 305 |
| F9-T242A-For | CtggattaaggaaaaaGCTaagctcacttaagtg | 306 |
| F9-T242V-For | CtggattaaggaaaaaGTGaagctcacttaagtg | 307 |
| F9-E240N/T242A-For | gtcaactggattaagAACaaaGCTaagctcacttaagtg | 308 |
| F9-E240N/T242V-For | gtcaactggattaagAACaaaGTGaagctcacttaagtg | 309 |
| F9-E240Q-For | gtcaactggattaagCAGaaaacaaagctcacttaaG | 310 |
| F9-E240S-For | gtcaactggattaagAGCaaaacaaagctcacttaaG | 311 |
| F9-E240A-For | gtcaactggattaagGCTaaaacaaagctcacttaaG | 312 |
| F9-E240D-For | gtcaactggattaagGACaaaacaaagctcacttaaG | 313 |
| F9-N178D-For | CAaagttcaccatctatGACaacatgttctgtgctggc | 314 |
| F9-N178Y-For | CAaagttcaccatctatTACaacatgttctgtgctggc | 315 |
| F9-Y177A-For | CTacaaagttcaccatcGCTaacaacatgttctgtGC | 316 |
| F9-Y177T-For | CTacaaagttcaccatcACCaacaacatgttctgtGC | 317 |
| F9-T175R-For | cttcgatctacaaagttcAGGatctataacaacatgttc | 318 |
| F9-T175E-For | cttcgatctacaaagttcGAAatctataacaacatgttc | 319 |
| F9-T175Q-For | cttcgatctacaaagttcCAGatctataacaacatgttc | 320 |
| F9-F174I-For | GTcttcgatctacaaagATCaccatctataacaacatg | 321 |
| F9-T175R/Y177T-For | cgatctacaaagttcAGGatcACCaacaacatgttctgtG | 322 |
| F9-Y94F/K98T-For | GAattattcctcaccacaacTTCaatgcagctattaatACCtacaaccatgacattG | 323 |
| F9-F145N/K148S-For | ggctggggaagagtcAACcacAGCgggagatcagctttaG | 324 |

Table 13 below sets forth the FIX variants that were generated, with the mutations indicated using numbering relative to the mature FIX polypeptide set forth in SEQ ID NO:3, and also chymotrypsin numbering.

TABLE 13

| FIX variants | | |
|---|---|---|
| Mutation (Mature FIX Numbering) | Mutation (Chymotrypsin Numbering) | SEQ ID NO. |
| Catalyst Biosciences WT | Catalyst Biosciences WT | 3 |
| N157D | N[157]D | 75 |
| Y155F | Y[155]F | 76 |
| A103N/N105S | A[103]N/N[105]S | 77 |

TABLE 13-continued

FIX variants

| Mutation (Mature FIX Numbering) | Mutation (Chymotrypsin Numbering) | SEQ ID NO. |
|---|---|---|
| D104N/K106S | D[104]N/K[106]S | 78 |
| K106N/V108S | K[106]N/V[108]S | 79 |
| D85N | D[85]N | 80 |
| T148A | T[148]A | 81 |
| K5A | K[5]A | 82 |
| D64N | D[64]N | 83 |
| D64A | D[64]A | 84 |
| N167D | N[167]D | 85 |
| N167Q | N[167]Q | 86 |
| S61A | S[61]A | 87 |
| S53A | S[53]A | 88 |
| T159A | T[159]A | 89 |
| T169A | T[169]A | 90 |
| T172A | T[172]A | 91 |
| T179A | T[179]A | 92 |
| Y155H | Y[155]H | 93 |
| Y155Q | Y[155]Q | 94 |
| S158A | S[158]A | 95 |
| S158D | S[158]D | 96 |
| S158E | S[158]E | 97 |
| N157Q | N[157]Q | 98 |
| D203N/F205T | D39N/F41T | 99 |
| D85N/D203N/F205T | D[85]N/D39N/F41T | 100 |
| K228N | K63N | 101 |
| D85N/K228N | D[85]N/K63N | 102 |
| I251S | I86S | 103 |
| D85N/I251S | D[85]N/I86S | 104 |
| D85N/D104N/K106S/I251S | D[85]N/D[104]N/K[106]S/I86S | 105 |
| A262S | A95bS | 106 |
| K413N | K243N | 107 |
| E410N | E240N | 108 |
| E239N | E74N | 109 |
| T241N/H243S | T76N/H78S | 110 |
| K247N/N249S | K82N/N84S | 111 |
| L321N | L153N | 112 |
| F314N/H315S | F145N/H147S | 113 |
| K392N/K394S | K222N/K224S | 114 |
| S319N/L321S | S151N/L153S | 115 |
| N260S | N95S | 116 |
| Y284N | Y117N | 117 |
| G317N | G149N | 118 |
| R318N/A320S | R150N/A152S | 119 |
| R318A | R150A | 120 |
| R318E | R150E | 121 |
| R318Y | R150Y | 122 |
| R312Q | R143Q | 123 |
| R312A | R143A | 124 |
| R312Y | R143Y | 125 |
| R312L | R143L | 126 |
| V202M | V38M | 127 |
| V202Y | V38Y | 128 |
| D203M | D39M | 129 |
| D203Y | D39Y | 130 |
| A204M | A40M | 131 |
| A204Y | A40Y | 132 |
| K400A/R403A | K230A/R233A | 133 |
| K400E/R403E | K230E/R233E | 134 |
| R403A | R233A | 135 |
| R403E | R233E | 136 |
| K400A | K230A | 137 |
| K400E | K230E | 138 |
| K293E | K126E | 139 |
| K293A | K126A | 140 |
| R333A | R165A | 141 |
| R333E | R165E | 142 |
| R338A | R170A | 143 |
| R338E | R170E | 144 |
| R338A/R403A | R170A/R233A | 145 |
| R338E/R403E | R170E/R233E | 146 |
| K293A/R403A | K126A/R233A | 147 |
| K293E/R403E | K126E/R233E | 148 |
| K293A/R338A/R403A | K126A/R170A/R233A | 149 |
| K293E/R338E/R403E | K126E/R170E/R233E | 150 |
| R318A/R403A | R150A/R233A | 151 |
| R318E/R403E | R150E/R233E | 152 |

TABLE 13-continued

FIX variants

| Mutation (Mature FIX Numbering) | Mutation (Chymotrypsin Numbering) | SEQ ID NO. |
|---|---|---|
| R318Y/E410N | R150Y/E240N | 153 |
| R338E/E410N | R170E/E240N | 154 |
| R338E/R403E/E410N | R170E/R233E/E240N | 155 |
| R318Y/R338E/R403E | R150Y/R170E/R233E | 156 |
| D203N/F205T/K228N | D39N/F41T/K63N | 157 |
| D203N/F205T/E410N | D39N/F41T/E240N | 158 |
| D203N/F205T/R338E | D39N/F41T/R170E | 159 |
| D203N/F205T/R338A | D39N/F41T/R170A | 160 |
| D203N/F205T/R318Y | D39N/F41T/R150Y | 161 |
| D203N/F205T/R338E/R403E | D39N/F41T/R170E/R233E | 162 |
| K228N/E410N | K63N/E240N | 163 |
| K228N/R338E | K63N/R170E | 164 |
| K228N/R338A | K63N/R170A | 165 |
| K228N/R318Y | K63N/R150Y | 166 |
| K228N/R338E/R403E | K63N/R170E/R233E | 167 |
| R403E/E410N | R233E/E240N | 168 |
| R318Y/R338E/E410N | R150Y/R170E/E240N | 169 |
| K228N/R318Y/E410N | K63N/R150Y/E240N | 170 |
| R318Y/R403E/E410N | R150Y/R233E/E240N | 171 |
| R318Y/R338E/R403E/E410N | R150Y/R170E/R233E/E240N | 172 |
| D203N/F205T/R318Y/E410N | D39N/F41T/R150Y/E240N | 173 |
| R333S | R165S | 186 |
| R338L | R170L | 187 |
| K316N | K148N | 189 |
| K316A | K148A | 190 |
| K316E | K148E | 191 |
| K316S | K148S | 192 |
| K316M | K148M | 193 |
| E239S | E74S | 194 |
| E239A | E74A | 195 |
| E239R | E74R | 196 |
| E239K | E74K | 197 |
| H257F | H92F | 198 |
| H257Y | H92Y | 199 |
| H257E | H92E | 200 |
| H257S | H92S | 201 |
| T412A | T242A | 202 |
| T412V | T242V | 203 |
| E410N/T412A | E240N/T242A | 204 |
| E410N/T412V | E240N/T242V | 205 |
| E410Q | E240Q | 174 |
| E410S | E240S | 175 |
| E410A | E240A | 176 |
| E410D | E240D | 206 |
| N346D | N178D | 207 |
| N346Y | N178Y | 208 |
| F314N/K316S | F145N/K148S | 177 |
| A103N/N105S/K228N | A[103]N/N[105]S/K63N | 217 |
| D104N/K106S/K228N | D[104]N/K[106]S/K63N | 218 |
| K228N/I251S | K63N/I86S | 180 |
| A103N/N105S/I251S | A[103]N/N[105]S/I86S | 181 |
| D104N/K106S/I251S | D[104]N/K[106]S/I86S | 182 |
| A103N/N105S/R318Y/R338E/R403E/E410N | A[103]N/N[105]S/R150Y/R170E/R233E/E240N | 219 |
| D104N/K106S/R318Y/R338E/R403E/E410N | D[104]N/K[106]S/R150Y/R170E/R233E/E240N | 220 |
| K228N/R318Y/R338E/R403E/E410N | K63N/R150Y/R170E/R233E/E240N | 221 |
| I251S/R318Y/R338E/R403E/E410N | I86S/R150Y/R170E/R233E/E240N | 222 |
| D104N/K106S/I251S/R318Y/R338E/R403E/E410N | D[104]N/K[106]S/I86S/R150Y/R170E/R233E/E240N | 223 |
| D104N/K106S/R318Y/E410N/R338E | D[104]N/K[106]S/R150Y/E240N/R170E | 224 |
| I251S/R318Y/E410N/R338E | I86S/R150Y/E240N/R170E | 225 |
| D104N/K106S/I251S/R318Y/R338E/E410N/ | D[104]N/K[106]S/I86S/R150Y/R170E/E240N | 226 |
| A103N/N105S/K247N/N249S | A[103]N/N[105]S/K82N/N84S | 178 |
| D104N/K106S/K247N/N249S | D[104]N/K[106]S/K82N/N84S | 179 |
| K228N/K247N/N249S | K63N/K82N/N84S | 183 |
| A103N/N105S/Y155F | A[103]N/N[105]S/Y[155]F | 227 |
| D104N/K106S/Y155F | D[104]N/K[106]S/Y[155]F | 228 |
| Y155F/K228N | Y[155]F/K63N | 229 |
| Y155F/I251S | Y[155]F/I86S | 230 |
| Y155F/K247N/N249S | Y[155]F/K82N/N84S | 231 |
| A103N/N105S/K247N/N249S/R318Y/R338E/R403E/E410N | A[103]N/N[105]S/K82N/N84S/R150Y/R170E/R233E/E240N | 232 |

TABLE 13-continued

FIX variants

| Mutation (Mature FIX Numbering) | Mutation (Chymotrypsin Numbering) | SEQ ID NO. |
|---|---|---|
| D104N/K106S/K247N/N249S/R318Y/R338E/R403E/E410N | D[104]N/K[106]S/K82N/N84S/R150Y/R170E/R233E/E240N | 233 |
| K228N/K247N/N249S/R318Y/R338E/R403E/E410N | K63N/K82N/N84S/R150Y/R170E/R233E/E240N | 234 |
| A103N/N105S/Y155F/R318Y/R338E/R403E/E410N | A[103]N/N[105]S/Y[155]F/R150Y/R170E/R233E/E240N | 235 |
| D104N/K106S/Y155F/R318Y/R338E/R403E/E410N | D[104]N/K[106]S/Y[155]F/R150Y/R170E/R233E/E240N | 236 |
| Y155F/K228N/R318Y/R338E/R403E/E410N | Y[155]F/K63N/R150Y/R170E/R233E/E240N | 237 |
| Y155F/I251S/R318Y/R338E/R403E/E410N | Y[155]F/I86S//R150Y/R170E/R233E/E240N | 238 |
| Y155F/K247N/N249S/R318Y/R338E/R403E/E410N | Y[155]F/K82N/N84S/R150Y/R170E/R233E/E240N | 239 |
| K247N/N249S/R318Y/R338E/R403E/E410N | K82N/N84S/R150Y/R170E/R233E/E240N | 240 |
| Y155F/R318Y/R338E/R403E/E410N | Y[155]F/R150Y/R170E/R233E/E240N | 241 |
| K247N/N249S/R318Y/R338E/E410N | K82N/N84S/R150Y/R170E/E240N | 242 |
| Y155F/R318Y/R338E/E410N | Y[155]F/R150Y/R170E/E240N | 243 |
| Y155F/K247N/N249S/R318Y/R338E/E410N | Y[155]F/K82N/N84S/R150Y/R170E/E240N | 244 |
| D104N/K106S/Y155F/K228N/K247N/N249S | D[104]N/K[106]S/Y[155]F/K63N/K82N/N84S | 245 |
| D104N/K106S/Y155F/K247N/N249S | D[104]N/K[106]S/Y[155]F/K82N/N84S | 246 |
| D104N/K106S/Y155F/K228N/ | D[104]N/K[106]S/Y[155]F/K63N | 247 |
| Y155F/K228N/K247N/N249S | Y[155]F/K63N/K82N/N84S | 248 |
| D104N/K106S/K228N/K247N/N249S | D[104]N/K[106]S/K63N/K82N/N84S | 184 |
| R318Y/R338E/R403E/E410S | R150Y/R170E/R233E/E240S | 249 |
| R318Y/R338E/R403E/E410N/T412V | R150Y/R170E/R233E/E240N/T242V | 250 |
| R318Y/R338E/R403E/E410N/T412A | R150Y/R170E/R233E/E240N/T242A | 251 |
| R318Y/R338E/R403E/T412A | R150Y/R170E/R233E/T242A | 252 |
| R318Y/R338E/E410S | R150Y/R170E/E240S | 253 |
| R318Y/R338E/T412A | R150Y/R170E/T242A | 254 |
| R318Y/R338E/E410N/T412V | R150Y/R170E/E240N/T242V | 255 |
| D85N/K228N/R318Y/R338E/R403E/E410N | D[85]N/K63N/R150Y/R170E/R233E/E240N | 256 |
| N260S/R318Y/R338E/R403E/E410N | N95S/R150Y/R170E/R233E/E240N | 257 |
| R318Y/R338E/N346D/R403E/E410N | R150Y/R170E/N178D/R233E/E240N | 258 |
| Y155F/N346D | Y[155]F/N178D | 259 |
| Y155F/R318Y/R338E/N346D/R403E/E410N | Y[155]F/R150Y/R170E/N178D/R233E/E240N | 260 |
| Y155F/N260S/N346D/ | Y[155]F/N95S/N178D | 261 |
| K247N/N249S/N260S | K82N/N84S/N95S | 262 |
| D104N/K106S/N260S | D[104]N/K[106]S/N95S | 185 |
| Y155F/N260S | Y[155]F/N95S | 263 |
| K247N/N249S/N260S/R318Y/R338E/R403E/E410N | K82N/N84S/N95S/R150Y/R170E/R233E/E240N | 264 |
| D104N/K106S/N260S/R318Y/R338E/R403E/E410N | D[104]N/K[106]S/N95S/R150Y/R170E/R233E/E240N | 265 |
| Y155F/N260S/R318Y/R338E/R403E/E410N | Y[155]F/N95S/R150Y/R170E/R233E/E240N | 266 |
| R318Y/R338E/T343R/R403E/E410N | R150Y/R170E/T175R/R233E/E240N | 267 |
| R338E/T343R | R170E/T175R | 268 |
| D104N/K106S/Y155F/N260S | D[104]N/K[106]S/Y[155]F/N95S | 269 |
| Y155F/K247N/N249S/N260S | Y[155]F/K82N/N84S/N95S | 270 |
| D104N/K106S/K247N/N249S/N260S | D[104]N/K[106]S/K82N/N84S/N95S | 271 |
| D104N/K106S/Y155F/K247N/N249S/N260S | D[104]N/K[106]S/Y[155]F/K82N/N84S/N95S | 272 |
| Y345A | Y177A | 213 |
| Y345T | Y177T | 214 |
| T343R | T175R | 209 |
| T343E | T175E | 210 |
| T343Q | T175Q | 211 |
| F342I | F174I | 212 |
| T343R/Y345T | T175R/Y177T | 215 |
| R318Y/R338E | R150Y/R170E | 188 |
| Y259F/K265T/Y345T | Y94F/K98T/Y177T | 216 |
| D104N/K106S/Y155F/K247N/N249S/R318Y/R338E/R403E/E410N | D[104]N/K[106]S/Y[155]F/K82N/N84S/R150Y/R170E/R233E/E240N | 326 |
| D104N/K106S/K228N/K247N/N249S/R318Y/R338E/R403E/E410N | D[104]N/K[106]S/K63N/K82N/N84S/R150Y/R170E/R233E/E240N | 327 |
| Y155F/K228N/K247N/N249S/R318Y/R338E/R403E/E410N | Y[155]F/K63N/K82N/N84S/R150Y/R170E/R233E/E240N | 328 |
| Y155F/K247N/N249S/N260S/R318Y/R338E/R403E/E410N | Y[155]F/K82N/N84S/N95S/R150Y/R170E/R233E/E240N | 329 |

TABLE 13-continued

FIX variants

| Mutation (Mature FIX Numbering) | Mutation (Chymotrypsin Numbering) | SEQ ID NO. |
|---|---|---|
| Y155F/R318Y/R338E/T343R/R403E/E410N | Y[155]F/R150Y/R170E/T175R/R233E/E240N | 330 |
| D104N/K106S/R318Y/R338E/T343R/R403E/E410N | D[104]N/K[106]S/R150Y/R170E/T175R/R233E/E240N | 331 |
| T343R/N346Y | T175R/N178Y | 332 |
| R318Y/R338E/N346Y/R403E/E410N | R150Y/R170E/N178Y/R233E/E240N | 333 |
| R318Y/R338E/T343R/N346Y/R403E/E410N | R150Y/R170E/T175R/N178Y/R233E/E240N | 334 |
| T343R/N346D | T175R/N178D | 335 |
| R318Y/R338E/T343R/N346D/R403E/E410N | R150Y/R170E/T175R/N178D/R233E/E240N | 336 |
| R318Y/R338E/Y345A/R403E/E410N | R150Y/R170E/Y177A/R233E/E240N | 337 |
| R318Y/R338E/Y345A/N346D/R403E/E410N | R150Y/R170E/Y177A/N178D/R233E/E240N | 338 |
| Y155F/K247N/N249S/R318Y/R338E/R403E | Y[155]F/K82N/N84S/R150Y/R170E/R233E | 339 |
| K247N/N249S/R318Y/R338E/R403E | K82N/N84S/R150Y/R170E/R233E | 340 |
| Y155F/K247N/N249S/R318Y/R403E/E410N | Y[155]F/K82N/N84S/R150Y/R233E/E240N | 341 |
| K247N/N249S/R318Y/R403E/E410N | K82N/N84S/R150Y/R233E/E240N | 342 |
| Y155F/K247N/N249S/R338E/R403E/E410N | Y[155]F/K82N/N84S/R170E/R233E/E240N | 343 |
| K247N/N249S/R338E/R403E/E410N | K82N/N84S/R170E/R233E/E240N | 344 |
| R318Y/R338E/T343R/R403E | R150Y/R170E/T175R/R233E | 345 |
| Y155F/R318Y/R338E/T343R/R403E | Y[155]F/R150Y/R170E/T175R/R233E | 346 |
| R318Y/R338E/T343R/E410N | R150Y/R170E/T175R/E240N | 347 |
| Y155F/R318Y/R338E/T343R/E410N | Y[155]F/R150Y/R170E/T175R/E240N | 348 |
| R318Y/T343R/R403E/E410N | R150Y/T175R/R233E/E240N | 349 |
| Y155F/R318Y/T343R/R403E/E410N | Y[155]F/R150Y/T175R/R233E/E240N | 350 |
| R338E/T343R/R403E/E410N | R170E/T175R/R233E/E240N | 351 |
| Y155F/R338E/T343R/R403E/E410N | Y[155]F/R170E/T175R/R233E/E240N | 352 |
| Y155F/K247N/N249S/R318Y/R338E/T343R/R403E/E410N | Y[155]F/K82N/N84S/R150Y/R170E/T175R/R233E/E240N | 353 |
| K247N/N249S/R318Y/R338E/T343R/R403E/E410N | K82N/N84S/R150Y/R170E/T175R/R233E/E240N | 354 |
| K228N/I251S/R318Y/R338E/R403E/E410N | K63N/I86S/R150Y/R170E/R233E/E240N | 355 |
| Y155F/K228N/I251S/R318Y/R338E/R403E/E410N | Y[155]F/K63N/I86S/R150Y/R170E/R233E/E240N | 356 |
| N260S/R318Y/R338E/T343R/R403E/E410N | N95S/R150Y/R170E/T175R/R233E/E240N | 357 |
| Y155F/N260S/R318Y/R338E/T343R/R403E/E410N | Y[155]F/N95S/R150Y/R170E/T175R/R233E/E240N | 358 |
| K228N/K247N/N249S/R318Y/R338E/T343R/R403E/E410N | K63N/K82N/N84S/R150Y/R170E/T175R/R233E/E240N | 359 |
| Y155F/K228N/K247N/N249S/R318Y/R338E/T343R/R403E/E410N | Y[155]F/K63N/K82N/N84S/R150Y/R170E/T175R/R233E/E240N | 360 |
| Y155F/R338E/T343R/R403E | Y[155]F/R170E/T175R/R233E | 361 |
| R338E/T343R/R403E | R170E/T175R/R233E | 362 |
| Y155F/R338E/T343R/R403E/E410S | Y[155]F/R170E/T175R/R233E/E240S | 363 |
| Y155F/N260S/R338E/T343R/R403E | Y[155]F/N95S/R170E/T175R/R233E | 364 |
| Y155F/I251S/R338E/T343R/R403E | Y[155]F/I86S/R170E/T175R/R233E | 365 |
| R318Y/R338E/T343R/R403E/E410S | R150Y/R170E/T175R/R233E/E240S | 366 |
| Y155F/K247N/N249S/T343R/R403E | Y[155]F/K82N/N84S/T175R/R233E | 367 |
| Y155F/K247N/N249S/R318Y/R338E/T343R/R403E | Y[155]F/K82N/N84S/R150Y/R170E/T175R/R233E | 368 |
| K247N/N249S/R318Y/R338E/T343R/R403E | K82N/N84S/R150Y/R170E/T175R/R233E | 369 |
| Y155F/K247N/N249S/R338E/T343R/R403E/E410N | Y[155]F/K82N/N84S/R170E/T175R/R233E/E240N | 370 |
| K247N/N249S/R338E/T343R/R403E/E410N | K82N/N84S/R170E/T175R/R233E/E240N | 371 |
| Y155F/K247N/N249S/R318Y/R338E | Y[155]F/K82N/N84S/R150Y/R170E | 372 |
| Y155F/K247N/N249S/R318Y/T343R | Y[155]F/K82N/N84S/R150Y/T175R | 373 |
| Y155F/K247N/N249S/R318Y/R403E | Y[155]F/K82N/N84S/R150Y/R233E | 374 |
| Y155F/K247N/N249S/R318Y/E410N | Y[155]F/K82N/N84S/R150Y/E240N | 375 |
| Y155F/K247N/N249S/R338E/R403E | Y[155]F/K82N/N84S/R170E/R233E | 376 |
| Y155F/K247N/N249S/R338E/T343R | Y[155]F/K82N/N84S/R170E/T175R | 377 |
| Y155F/K247N/N249S/R318Y/R338E/T343R/E410N | Y[155]F/K82N/N84S/R150Y/R170E/T175R/E240N | 378 |
| K247N/N249S/R318Y/R338E/T343R/E410N | K82N/N84S/R150Y/R170E/T175R/E240N | 379 |
| Y155F/K247N/N249S/R318Y/T343R/R403E/E410N | Y[155]F/K82N/N84S/R150Y/T175R/R233E/E240N | 380 |

TABLE 13-continued

FIX variants

| Mutation (Mature FIX Numbering) | Mutation (Chymotrypsin Numbering) | SEQ ID NO. |
|---|---|---|
| K247N/N249S/R318Y/T343R/R403E/E410N | K82N/N84S/R150Y/T175R/R233E/E240N | 381 |
| Y155F/K247N/N249S/R338E/E410N | Y[155]F/K82N/N84S/R170E/E240N | 382 |
| Y155F/K247N/N249S/R318Y/T343R/R403E | Y[155]F/K82N/N84S/R150Y/T175R/R233E | 383 |
| K247N/N249S/R318Y/T343R/R403E | K82N/N84S/R150Y/T175R/R233E | 384 |
| Y155F/K247N/N249S/R318Y/T343R/E410N | Y[155]F/K82N/N84S/R150Y/T175R/E240N | 385 |
| K247N/N249S/R318Y/T343R/E410N | K82N/N84S/R150Y/T175R/E240N | 386 |
| Y155F/K247N/N249S/R338E/T343R/R403E | Y[155]F/K82N/N84S/R170E/T175R/R233E | 387 |
| K247N/N249S/R338E/T343R/R403E | K82N/N84S/R170E/T175R/R233E | 388 |
| Y155F/K247N/N249S/R338E/T343R/E410N | Y[155]F/K82N/N84S/R170E/T175R/E240N | 389 |
| K247N/N249S/R338E/T343R/E410N | K82N/N84S/R170E/T175R/E240N | 390 |
| Y155F/K247N/N249S/T343R/R403E/E410N | Y[155]F/K82N/N84S/T175R/R233E/E240N | 391 |
| K247N/N249S/T343R/R403E/E410N | K82N/N84S/T175R/R233E/E240N | 392 |
| Y155F/R318Y/R338E/T343R | Y[155]F/R150Y/R170E/T175R | 393 |
| R318Y/R338E/T343R | R150Y/R170E/T175R | 394 |
| Y155F/R318Y/T343R/R403E | Y[155]F/R150Y/T175R/R233E | 395 |
| Y155F/T343R/R403E/E410N | Y[155]F/T175R/R233E/E240N | 396 |
| Y155F/K247N/N249S/R318Y/R338E/T343R | Y[155]F/K82N/N84S/R150Y/R170E/T175R | 397 |
| K247N/N249S/R318Y/R338E/T343R | K82N/N84S/R150Y/R170E/T175R | 398 |
| Y155F/K247N/N249S/T343R/E410N | Y[155]F/K82N/N84S/T175R/E240N | 399 |
| Y155F/K247N/N249S/R403E/E410N | Y[155]F/K82N/N84S/R233E/E240N | 400 |
| Y155F/R338E/T343R/E410N | Y[155]F/R170E/T175R/E240N | 401 |
| R338E/T343R/E410N | R170E/T175R/E240N | 402 |
| Y155F/R318Y/T343R/E410N | Y[155]F/R150Y/T175R/E240N | 403 |
| R318Y/T343R/E410N | R150Y/T175R/E240N | 404 |
| K228N/R318Y/R338E/T343R/R403E/E410N | K63N/R150Y/R170E/T175R/R233E/E240N | 405 |
| K228N/K247N/N249S/R318Y/R338E/T343R/R403E | K63N/K82N/N84S/R150Y/R170E/T175R/R233E | 406 |
| K228N/K247N/N249S/R318Y/R338E/T343R/E410N | K63N/K82N/N84S/R150Y/R170E/T175R/E240N | 407 |
| K228N/K247N/N249S/R318Y/T343R/R403E/E410N | K63N/K82N/N84S/R150Y/T175R/R233E/E240N | 408 |
| Y155F/R338E/R403E/E410N | Y[155]F/R170E/R233E/E240N | 409 |
| Y155F/R318Y/R338E/R403E | Y[155]F/R150Y/R170E/R233E | 410 |
| Y155F/R318Y/R403E/E410N | Y[155]F/R150Y/R233E/E240N | 411 |
| Y1N | Y[1]N | 412 |

C. Expression and Purification of FIX Polypeptides

Wild-type and variant FIX polypeptides were expressed in CHO-Express (CHOX) cells (Excellgene). CHO Express (CHOX) cells were maintained in DM204B Complete medium (Irvine Scientific) and used to inoculate production seed cultures. Seed cultures were grown in the same media to approximately $1.4 \times 10^7$ viable cells (vc)/mL and approximately 100 mL used to inoculate approximately 1.0 L of DM204B Complete media, so that the inoculation density was $1.2 \times 10^6$ vc/mL. This culture was grown for 3 days to reach $13-16 \times 10^6$ vc/mL on the day of transfection. A transfection complex was formed by mixing FIX plasmid DNA (3.2 mg) with Polyethylenimine "MAX" (PEI-20.5 mg (Polysciences)) and diluting to 1.0 L with serum-free TfMAX2 transfection medium (Mediatech). This mixture was then added to the 1.0 L production culture. 1.0 L aliquots of the cells plus transfection mix were split into 2×3 L baffled Fernback Flasks and allowed to express for 4 days before harvesting the crude FIX. Culture supernatants were then harvested by filtration and FIX was purified.

Larger-scale cultures of 10 L or greater were produced in WAVE bioreactors (GE Healthcare). 20 L wave bags were inoculated with approximately 400 mL of seed culture, grown as described above, with 4.6 L of DM204B Complete media to a seeding density of $1.2 \times 10^6$ vc/mL. The WAVE bioreactor was set to a rocking angle of 6 degrees, rocking rate of 24 rpm at 37.1° C. in order to allow the cells to reach a cell density of $13-16 \times 10^6$ vc/mL 3 days later. 16 mg of FIX plasmid DNA and 102.5 mg of PEI were combined to form a transfection complex, which was diluted in 5.0 L of TfMAX2 prior to addition to the culture on the WAVE bioreactor, 3 days after the initial seeding. While the Transfection complex plus TfMAX media was added to the wave bag, the rocking angle of the WAVE Bioreactor was set to 8 degrees and the temperature to 33° C., while the other settings remained the same. The culture was allowed to express for 4 days before harvesting the crude FIX. The contents of the wave bags were allowed to settle for 3 hrs at 4° C. prior to harvesting the culture supernatant through a CUNO depth filter and then the FIX was purified.

FIX polypeptides were purified using a Capto Q column (GE Healthcare), to which FIX polypeptides with functional Gla domains adsorb, followed by a calcium elution step. Typically, EDTA (10 mM), Tris (25 mM, pH 8.0), and Tween-80 (0.001%) were added to the culture supernatant from the transfected cells. The samples were loaded onto a Capto Q column that had been pre-equilibrated with Buffer B (25 mM Tris pH 8, 1 M NaCl, 0.001% Tween-80), followed by equilibration with Buffer A (25 mM Tris pH 8, 0.15 M NaCl, 0.001% Tween-80). Immediately following completion of sample loading, the column was washed with 14% Buffer B (86% Buffer A) for 20 column volumes. Buffer C (25 mM Tris pH 8, 0.2 M NaCl, 0.001% Tween-80, 10 mM $CaCl_2$) was then applied to the column to elute the FIX polypeptides that were collected as a pool.

The eluted pool was further purified using a Q Sepharose HP column (GE Healthcare). The sample was prepared for application by diluting with 2 volumes of Buffer D (25 mM Tris pH 8, 0.001% Tween-80). The diluted sample was loaded onto a Q Sepharose HP column that had been pre-equilibrated with Buffer F (25 mM Tris pH 8, 1 M NaCl, 2.5 mM $CaCl_2$, 0.001% Tween-80), followed by Buffer E (25 mM Tris pH 8, 2.5 mM $CaCl_2$, 0.001% Tween-80). After washing with 4% Buffer F (96% Buffer E), a gradient from 4-40% Buffer F was applied to the column and fractions were collected. Fractions containing FIX polypeptides were then pooled.

D. Purification to Enrich for Glycosylated Polypeptides.

The extent of glycosylation of the modified FIX polypeptides was estimated using SDS-polyacrylamide gel electrophoresis. Hyperglycosylation was assessed by comparison of the migration pattern of the modified FIX polypeptide with a wild type FIX, Benefix®Coagulation FIX. Hyperglycosylated forms of the enzyme migrated slower, exhibiting a higher apparent molecular weight, than the wild type polypeptide. It was observed that the polypeptides containing the E240N mutation, which introduces a non-native N-glycosylation site at position 240, were only partially glycosylated (approximately 20% glycosylation). To enrich for the hyperglycosylated form, a modification of the purification process described above was performed.

The first step of purification was performed using the Capto Q column, as described above. The eluted pool from this column was diluted with 2 volumes of Buffer D (as above) and the sample was loaded onto a Heparin Sepharose column that had been pre-equilibrated with Buffer F (as above), followed by Buffer E (as above). The column was then developed with a gradient from 0% to 70% Buffer F and fractions were collected. The hyperglycosylated form of the E410N variant eluted from the column in approximately 35% Buffer F, whereas the non-hyperglycosylated form eluted in approximately 50% Buffer F. Each collected pool was further purified on the Q Sepharose HP column as described above. By this method a pool containing approximately 80% hyperglycosylated form of the E410N variant was obtained. The extent of hyperglycosylation was estimated by visual inspection of SDS-polyacrylamide gel electrophoresis.

Example 2

Activation of FX and Determination of the Catalytically Active Protease (FXa) Concentration using the Active Site Titrant Fluorescein-mono-p'-guanidinobenzoate (FMGB)

The concentration of Factor X (FX) in a stock of FX that can become catalytically active was determined. This stock of FX was then used in subsequent studies to calculate the catalytic activity of FIX variants for FX. Following activation of FX to FXa, the active site titration assay was carried out essentially as described by Bock et al. (*Archives of Biochemistry and Biophysics* (1989) 273:375-388) using the fluorogenic ester substrate fluorescein-mono-p'-guanidinobenzoate (FMGB), with a few minor modifications. FMGB readily reacts with FXa, but not FX or inactive protease, to form an effectively stable acyl-enzyme intermediate under conditions in which the concentration of FMGB is saturating and deacylation is especially slow and rate limiting for catalysis. Under these conditions, the FXa protease undergoes a single catalytic turnover to release the fluorescein fluorophore. When the initial burst of fluorescence is calibrated to an external concentration standard curve of fluorescein fluorescence, the concentration of active sites can be calculated.

A. Activation of FX to FXa

The concentration of FX in a stock solution that is able to become catalytically active was determined by activation of FX samples with Russell's Viper Venom, followed by titrating the active FX (FXa) with FMGB. FX zymogen stocks were first pre-treated by the supplier with DFP (diisopropylfluorophosphate) and EGR-cmk to reduce the background FXa activity. FXa activation reactions were prepared with a final concentration of 10 µM FX (based on the $A_{280}$ absorbance and an extinction coefficient of 1.16) in a final volume of 50-100 µL in a reaction buffer containing 100 mM Tris, 50 mM NaCl, 5 mM $CaCl_2$, 0.1% PEG 8000, pH 8.1. Activation was initiated by the addition of Russell's Viper Venom (RVV-Xase; Heamatologic Technologies, Inc.) to a final concentration of 5 pg/mL (5 µL of a 98 µg/mL dilution per 100 µL reaction or 2.5 µL per 50 µL reaction) at 37° C. for 45-60 min of activation time (previously determined to represent complete activation by collecting samples every 15 min and testing the increase in cleavage of Spectrafluor FXa fluorogenic substrate). Reactions were quenched with 1/10 volume of quench buffer containing 100 mM Tris, 50 mM NaCl, 5 mM, 100 mM EDTA, 0.1% PEG 8000, pH 8.1.

B. Active Site Titration.

The active site titration assays were performed with a 1 mL reaction volume in a 0.4 cm×1 cm quartz cuvette under continuous stirring. Reactions contained 100-400 nM of the freshly activated FXa and 5 µM FMGB in an assay buffer containing 30 mM Hepes, 135 mM NaCl, 1 mM EDTA and 0.1% PEG 8000, pH 7.4. FMGB was prepared at a stock concentration of 0.01 M in DMF based on the dry weight and the concentration confirmed by absorbance spectroscopy at 452 nm using an extinction coefficient of 19,498 $M^{-3}$ $cm^{-1}$ in Phosphate Buffered Saline (PBS), pH 7.2. Assays were initiated by adding 5 µL of 1 mM FMGB (5 µM final concentration) to 1 mL of 1× assay buffer and first measuring the background hydrolysis of FMGB for ~150-200 seconds before the addition of FXa to a final concentration of ~100-400 nM. The release of fluorescein fluorescence in the burst phase of the reaction was followed for an additional 3600 seconds.

The amount of fluorescein released following catalysis of FMGB by FXa was determined using a standard curve of free fluorescein. The fluorescein standard solution was freshly prepared at a stock concentration of ~70-150 mM in DMF and the accurate concentration was confirmed by absorbance spectroscopy under standard conditions at 496 nm using an extinction coefficient of 89,125 $cm^{-1}$ in 0.1 N NaOH. A standard curve of free fluorescein was then prepared by titration of the absorbance-calibrated fluorescein standard into 1× assay buffer in 20 nM steps to a final concentration of 260-300 nM.

For data analysis, reaction traces were imported into the Graphpad Prism software package and the contribution of background hydrolysis was subtracted from the curve by extrapolation of the initial measured rate of spontaneous FMGB hydrolysis, which was typically less than 5% of the total fluorescence burst. The corrected curve was fit to a single exponential equation with a linear component (to account for the slow rate of deacylation) of the form $\Delta Fluorescence = Amp(1-e^{kt})+Bt$, where Amp=the amplitude of the burst phase under the saturating assay conditions outline above, k is the observed first order rate constant for acyl-enzyme formation and B is a bulk rate constant associated with complete turnover of FMGB. The concentration of active FXa protease was calculated by comparison of the fit parameter for amplitude to the fluorescein standard curve. The values from multiple assays were measured, averaged and the standard deviation determined. The amount of active FXa in the preparation directly represents the concentration of FX in a stock preparation that can be activated by FIXa. This active site titrated value was employed when calculating the concentration of FX to be used in an indirect assay, such as the cofactor-dependent assay described in Example 4, below.

Example 3

Activation of FIX and Determination of the Catalytically Active Protease (FIXa) Concentration using the Active Site Titrant 4-methylumbelliferyl p'-guanidinobenzoate (MUGB)

The concentration of Factor IX (FIX) in a stock solution of the FIX zymogen that is able to become catalytically active was determined by activation of FIX samples, including FIX variants, with Factor XIa (FXIa; Heamatologic Technologies, Inc.) followed by titrating the active Factor IX (FIXa) with 4-methylumbelliferyl p'-guanidinobenzoate (MUGB).

A. Activation of FIX to FIXa

Total protein concentrations in the FIX polypeptide preparations were determined by the $A_{280}$ absorbance using an extinction coefficient unique for each variant (i.e. $\epsilon_{280}$=number of Tyr residues×1490+number Trp residues×5500+number Cys residues×125). Activation reactions of FIX to FIXa were prepared at a final concentration of 10 μM FIX in a final volume of 200-500 μL in a reaction buffer containing 100 mM Tris, 50 mM NaCl, 5 mM CaCl$_2$, 0.1% PEG 8000, pH 8.1. Activations were initiated by the addition of FXIa or biotinylated FXIa to a final concentration of 20 nM at 37° C. for 60 min of activation time. A 60 minute activation time was previously determined to represent complete activation by collecting samples every 15 min and assaying for total cleavage by SDS-PAGE.

The free FXIa or biotinylated FXIa used in the activation reaction was then removed from the samples using one of two methods that produce equivalent results, each removing greater than 95-97% of the catalytic FXIa. In the first method, which was used to remove free FXIa, activation reactions initiated with FXIa were mixed with an anti-FXIa monoclonal antibody (Abcam 20377) to a final concentration of 50 nM for 60 min at 37° C. Antibody capture of free FXIa was followed by the addition of washed protein G Dynal Beads (30 mg/mL; Invitrogen) to a final concentration of 25% vol:vol for an additional 120 min at room temperature. The Dynal Beads were removed from the solution per the manufacturer's instructions. In the second method, which was used to removed biotinylated FXIa, activation reactions using biotinylated FXIa were mixed with Streptavidin Dynal Beads (10 mg/mL; Invitrogen) to a final concentration of 10% vol:vol for 60 min at room temperature. The Dynal Beads were then removed per the manufacturer's instructions. Following removal of the FXIa, the total protein concentrations of activated FIXa samples were determined by $A_{280}$ absorbance using an extinction coefficient unique for each variant (as described above).

B. Active Site Titration of FIXa

The concentration of catalytically active FIXa in an activated stock solution was determined by titrating the FIXa samples with a fluorogenic ester substrate, 4-methylumbelliferyl p'-guanidinobenzoate (MUGB). The principle titration assay was carried out essentially as described by Payne et al. (*Biochemistry* (1996) 35:7100-7106) with a few minor modifications to account for the slower reactivity of MUGB with FIXa. MUGB readily reacts with FIXa, but not FIX or inactive protease, to form an effectively stable acyl-enzyme intermediate under conditions in which the concentration of MUGB is saturating and deacylation is especially slow and rate limiting for catalysis. Under these conditions, the FIXa protease undergoes a single catalytic turnover to release the 4-methylumbelliferone fluorophore (4-MU). When the initial burst of fluorescence is calibrated to an external concentration standard curve of 4-MU fluorescence, the concentration of active sites can be calculated.

Assays were performed with a 1 mL reaction volume in a 0.4 cm×1 cm quartz cuvette, under continuous stirring with an assay buffer containing 50 mM Hepes, 100 mM NaCl, 5 mM CaCl$_2$ and 0.1% PEG 8000, pH 7.6. MUGB was prepared at a stock concentration of 0.04 M in DMSO based on the dry weight and diluted to a working concentration of 2 mM in DMSO. Titration assays were initiated by adding 4 μL of 2 mM MUGB to a final concentration of 8 μM in 1× assay buffer and first measuring the background hydrolysis of MUGB for ~200-300 seconds before the addition of the FIXa or FIXa variant to a final concentration of 100-200 nM based on the total protein concentration determined for the activation reaction after removal of FXIa. The release of 4-MU fluorescence in the burst phase of the reaction was followed for a total of 2 hours in order to acquire sufficient data from the initial burst and subsequent steady state phases.

The amount of 4-MU released following catalysis of MUGB by FIXa was determined using a standard curve of 4-MU. A 4-MU standard solution was prepared at a stock concentration of 0.5 M in DMSO and the concentration confirmed by absorbance spectroscopy at 360 nm using an extinction coefficient of 19,000 $M^{-1}$ $cm^{-1}$ in 50 mM Tris buffer, pH 9.0. The standard curve of free 4-MU was prepared by titration of the absorbance-calibrated 4-MU into 1× assay buffer in 20 nM steps to a final concentration of 260-300 nM 4-MU.

For data analysis, reaction traces were imported into the Graphpad Prism software package and the contribution of background hydrolysis was subtracted from the curve by extrapolation of the initial measured rate of spontaneous MUGB hydrolysis, which was typically less than 5% of the total fluorescence burst. The corrected curve was fit to a single exponential equation with a linear component (to account for the slow rate of deacylation in the steady state phase) of the form $\Delta$Fluorescence=Amp(1-$e^{-kt}$)+Bt, where Amp=the amplitude of the burst phase under the saturating assay conditions outline above, k is the observed first order rate constant for acyl-enzyme formation and B is a bulk rate constant associated with complete turnover of MUGB. The concentration of active FIXa protease is calculated by comparison of the fit parameter for amplitude to the 4-MU standard curve. The values from multiple assays were measured, averaged and the standard deviation determined. The concentration of FIX zymogen, which may become activated, in a stock solution was then determined by multiplying the $A_{280}$ determined total concentration of the FIX zymogen by the experimentally determined fraction active value for the fully activated sample (concentration of active FIXa/total concentration of FIXa).

Example 4

Determination of the Catalytic Activity of FIXa for its Substrate, Factor X

The catalytic activity of the FIXa variants for the substrate, Factor X (FX), was assessed indirectly in a fluorogenic assay by assaying for the activity of FXa, generated upon activation by FIXa, on the synthetic substrate Spectrafluor FXa. A range of FX concentrations were used to calculate the kinetic rate constants where the substrate protease (FX) was in excess by at least a 1000-fold over the concentration of the activating protease (FIXa). Briefly, activated and active site titrated FIXa was incubated in a calcium containing buffer with recombinant FVIII, phospholipid vesicles and alpha-thrombin (to activate FVIII to FVIIIa), forming the tenase (Xase) complex. The activity of alpha-thrombin was then quenched by the addition of a highly specific thrombin inhibitor, hirudin, prior to initiating the assay. FIXa variants (as part of the Xase complex) were subsequently mixed with various concentrations of FX and the fluorescent substrate, Spectrafluor FXa ($CH_3SO_2$-D-CHA-Gly-Arg-AMC) to initiate the assay. The release of the free fluorophore, AMC (7-amino-4-methylcoumarin) following catalysis of Spectrafluor FXa by FXa was then assessed continuously over a time period, and the kinetic rate constants of the FIXa variants determined A. Assay Protocol For assays evaluating the kinetic rate of FX activation by FIXa in the presence of FVIIIa and phospholipids, recombinant FVIII (Kogenate FS®; Bayer healthcare) was first resuspended in 5 mL of the provided diluent according to the manufacturer's instructions. The molar concentration of FVIII was then determined by absorbance at 280 nm using an extinction coefficient of 1.567 $mg^{-1}$ mL $cm^{-1}$ and a molecular weight of 163.6 kDa. The FIX variants were expressed, purified, activated and active site titrated as described in Examples 1-3, above. FIXa variants were then serially diluted to a concentration of 16 pM in a 200 µL volume of 1× Buffer A (20 mM Hepes/150 mM NaCl/5 mM $CaCl_2$/0.1% BSA/0.1% PEG-8000, pH 7.4). In preparation for activation of FVIII to FVIIIa in the presence of FIXa and phospholipids, alpha-thrombin (Heamatologic Technologies, Inc.) and hirudin (American Diagnostica) were each diluted in a 1.0 mL volume of 1× Buffer A to 64 nM and 640 nM, respectively. Reconstituted FVIII was further diluted to a concentration of 267 nM in a 10 mL volume of 1× Buffer A containing 267 µM freshly resuspended phospholipids (75% phosphatidylcholine (PC)/25% phosphatidylserine (PS); PS/PC vesicles ~120 nm in diameter; Avanti Polar Lipids). FVIII was activated to FVIIIa by mixing 600 µL of the above FVIII/PC/PS solution with 100 µL of the 16 µM wild-type FIXa or FIXa variant dilution and 50 µL of the 64 nM alpha-thrombin solution followed by 15 minutes of incubation at 25° C. Activation reactions were subsequently quenched by the addition of 50 µL of the above 640 nM hirudin solution for 5 min at 25° C. prior to initiating the kinetic assay for FX activation. The final concentration of reagents in the 800 µL Xase complex solutions was as follows: 2 pM FIXa variant, 200 nM FVIIIa, 200 µM PC/PS vesicles, 4 nM alpha-thrombin (inhibited) and 40 nM hirudin.

A total of 25 µL of each Xase complex solution (FIXa/FVIIIa/Phospholipids/$Ca^{2+}$) was aliquoted into a 96-well half-area black assay plate according to a predefined plate map (4 FIXa variants/plate). A solution of 900 nM active site titrated and DFP/EGR-cmk treated FX (see Example 2, above) was prepared in 5.6 mL of 1× Buffer A containing 1.0 mM Spectrafluor Xa substrate. This represented the highest concentration of FX tested and a sufficient volume for 4 assays. The FX/Spectrafluor Xa solution was then serially diluted 1.8-fold in an 8-channel deep-well polypropylene plate with a final volume of 2.5 mL 1× Buffer A that contains 1.0 mM Spectrafluor Xa, resulting in final dilutions of 900 nM, 500 nM, 277.8 nM, 154.3 nM, 85.7 nM, 47.6 nM, 25.6 nM and 0 nM FX. Alternatively in some assays, the FX/Specrafluor Xa solution was then serially diluted 1.5-fold in a 12-channel deep-well polypropylene plate with a final volume of 2.5 mL 1× Buffer A that contains 1.0 mM Spectrafluor Xa, resulting in final dilutions of 900 nM, 600 nM, 400 nM, 266.7 nM, 177.8 nM, 118.5 nM, 79.0 nM, 52.7 nM, 35.1 nM, 23.4 nM, 15.6 nM and 0 nM FX. Assay reactions were typically initiated using a BioMek FX liquid handling system programmed to dispense 25 µL of the FX/Spectrafluor Xa dilutions into 4 assay plates containing 25 µL of each FIXa variant (Xase complex). The final concentrations of the reagents in the assay were as follows: 1 pM FIXa, 100 nM FVIIIa, 100 µM PC/PS vesicles, 0.5 mM Spectrafluor Xa, 2 nM alpha-thrombin (inhibited), 20 nM hirudin and FX dilutions of 0 nM to 450 nM. Reactions were monitored in a SpectraMax fluorescence plate reader for 30 mM at 37° C. A standard curve of free AMC served as the conversion factor for RFU to µM in the subsequent data analysis calculations using a dose range that covered 0 µM to 100 µM AMC.

B. Data Analysis

All equations used to determine the steady-state kinetics of the catalysis of FX by FIXa are based on those described in the reference "Zymogen-Activation Kinetics: Modulatory effects of trans-4-(aminomethyl)cyclohexane-1-carboxylic acid and poly-D-lysine on plasminogen activation" in Petersen, et al. (1985) Biochem. J. 225:149-158. The theory for the steady-state kinetics of the system described by Scheme A (see below) is described by the expression of equation (1) that represents a parabolic accumulation of product.

Scheme A:

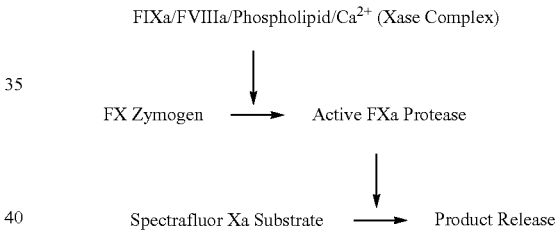

According to the mechanism of Scheme A, $a_0$ is the concentration of activating protease (FIXa), $z_0$ is the concentration of zymogen (FX), $k_a$ and $K_z$ represent the $k_{cat}$ and $K_M$ for the activator-catalyzed conversion of zymogen to active enzyme (FXa), whereas $k_e$ and $K_s$ represent the $k_{cat}$ and $K_M$ for conversion of substrate to product by FXa over a given time t:

$$p = a_0 \frac{k_a[z_0]}{K_z + [z_0]} * \frac{k_e[S_0]}{K_s + [S_0]} * \frac{t^2}{2} \qquad \text{Equation (1)}$$

For analysis of progress curves, equation (1) was re-cast in the form of equation (2) where the steady-state kinetics of FXa hydrolysis of the fluorogenic substrate were determined independently and replaced by the compound constant $k_2$.

$$p = a_0 \frac{k_a[z_0]}{K_z + [z_0]} * k_2 * \frac{t^2}{2} \qquad \text{Equation (2)}$$

The FXa activity on Spectrofluor FXa in 1× Buffer A was independently determined to have a $K_M$ of 313.0 µM and a $k_{cat}$ value of 146.4 s$^{-1}$. Substitution of these values into equation (3) gave a $k_2$ correction factor of 90 s$^{-1}$.

$$k_2 = \frac{k_e[S_0]}{K_M + [S_0]} \quad \text{Equation (3)}$$

To determine the degree of FIXa catalytic activity, raw data collected with the SoftMax Pro application (Molecular Devices) were exported as .XML files or .TXT files. Further non-linear data analyses were performed with XLfit4, a software package for automated curve fitting and statistical analysis within the Microsoft Excel spreadsheet environment (IDBS Software) or directly within the ActivityBase software package using the XE Runner data analysis module (IDBS Software). The spreadsheet template was set up to automatically fit the parabolic reaction velocities (μM/sec$^2$) of the tested FIXa variants at each FX concentration to the function of a standard rectangular hyperbola (i.e. Michaelis Menten equation) given by equation (4) to yield the fit values for V$_{max}$ and K$_M$.

$$\text{Reaction Velocity}(\mu M / \sec^2) = \frac{V_{max}[S_0]}{K_M + [S_0]} \quad \text{Equation (4)}$$

The $k_{cat}$ value for the tested FIXa variant was then calculated from the fit value for $V_{max}$ (μM/sec$^2$) by equation (5).

$$k_{cat} = \frac{V_{max}}{[FIXa] * 0.5 * k_2} \quad \text{Equation (5)}$$

The specificity constant $K_{cat}/K_M$ was calculated directly from the fit value of $K_M$ and the calculated $k_{cat}$ that arose from evaluation of equation (5) above.

Tables 14-19 set forth the catalytic activity for each of the FIXa variants assayed. Also assayed were recombinant wild-type FIXa (termed Catalyst Biosciences WT; generated as described above in Example 1), plasma purified FIXa (Haematologic Technologies, Inc.), and BeneFIX® (Coagulation Factor IX (Recombinant); Wyeth). Tables 14-15 present the results expressed as the kinetic constant for catalytic activity, $k_{cat}/K_M$ (M$^{-1}$s$^{-1}$), and also as the percentage of the activity of the wild-type FIXa, wherein the activity is catalytic activity, $k_{cat}/K_M$ (M$^{-1}$s$^{-1}$) of each FIXa variant for its substrate, FX. The individual rate constants $k_{cat}$ and $K_M$ are provided in Tables 16-17 and 18-19, respectively. Tables 15, 17 and 19 reflect data for additional FIXa variants and provide new overall averages calculated to include additional experimental replicates (n) for FIXa variants in Tables 14, 16 and 18. Where the activity of the FIXa variant was compared to wild-type FIXa, it was compared to a recombinant wild-type FIXa polypeptide that was expressed and purified using the same conditions as used for the variant FIXa polypeptides to ensure that any differences in activity were the result of the mutation(s), and not the result of differences in, for example, post-translational modifications associated with different expression systems. Thus, the wild-type FIXa polypeptide used for comparison was the recombinant wild-type FIXa generated from cloning the FIX gene set forth in SEQ ID NO:1 and expressed from CHOX cells as a polypeptide with an amino acid sequence set forth in SEQ ID NO:3, as described in Example 1 (i.e. Catalyst Biosciences WT FIX polypeptide). The standard deviation (S.D.), coefficient of variation (as a percentage; % CV) and the number of assays performed (n) also are provided for each kinetic parameter.

The observed catalytic activities of the FIXa variants ranged from no detectable Xase activity in a few variants (e.g. FIXa-F314N/H315S, FIXa-G317N, FIXa-R318N/A320S and FIXa-K400E/R403E) to a greater than 10-fold increase in $k_{cat}/K_M$ for the activation of FX compared to wild-type FIXa. Some of the variants displayed markedly increased catalytic activity compared to the wild-type FIXa, including FIXa-R338E, FIXa-R338A, FIXa-T343R, FIXa-E410N and combinations thereof such as FIXa-R318Y/R338E/E410N, FIXa-R318Y/R338E/R402E/E410N, FIXa-R318Y/R338E/T343R/R402E/E410N, FIXa-R318Y/R338E/T343R/E410N and FIXa-R338E/T343R displayed some of the greatest increases in catalytic activity. Although several FIXa variants with single or multiple additional glycosylation sites demonstrated close to wild-type activity (e.g. FIXa-I251 S, FIXa-D85N/I251S, FIXa-K63N, FIXa-K247N/N249S and FIXa-K63N/K247N/N249S) or improved activity when combined with other mutations (e.g. FIXa-K247N/N249S/R338E/T343R/R403E and FIXa-K247N/N249S/R318Y/R338E/T343R/R403E/E410N), others showed reduced catalytic activity. The augmented catalytic activity was due to improvements in $k_{cat}$ or $K_M$ or most often, both parameters.

TABLE 14

Catalytic activity of FIXa variants ($k_{cat}/K_M$)

| Mutation (Mature FIX Numbering) | Mutation (Chymotrypsin Numbering) | $k_{cat}/K_M$ (M$^{-1}$s$^{-1}$) | ±S.D. (M$^{-1}$s$^{-1}$) | % CV | % of WT $k_{cat}/K_M$ | n |
|---|---|---|---|---|---|---|
| BeneFIX Benefix ® Coagulation FIX (T148A) | BeneFIX Benefix ® Coagulation FIX (T[148]A) | 4.1E+07 | 2.1E+07 | 51% | 91% | 125 |
| Plasma Purified FIXa | Plasma Purified FIXa | 5.2E+07 | 2.2E+07 | 41% | 117% | 120 |
| Catalyst Biosciences WT | Catalyst Biosciences WT | 4.5E+07 | 2.5E+07 | 56% | 100% | 31 |
| N157D | N[157]D | 2.9E+07 | 8.1E+06 | 28% | 64% | 2 |
| Y155F | Y[155]F | 4.1E+07 | 1.3E+05 | 0% | 93% | 2 |
| A103N/N105S/Y155F | A[103]N/N[105]S/Y[155]F | 3.9E+07 | 1.4E+06 | 4% | 88% | 2 |
| D104N/K106S/Y155F | D[104]N/K[106]S/Y[155]F | 3.6E+07 | 1.0E+06 | 3% | 81% | 2 |
| A103N/N105S | A[103]N/N[105]S | 3.7E+07 | 1.4E+07 | 38% | 82% | 9 |
| D104N/K106S | D[104]N/K[106]S | 3.8E+07 | 1.3E+07 | 34% | 86% | 9 |
| K106NN108S | K[106]NN[108]S | 2.8E+07 | 6.7E+06 | 24% | 62% | 7 |
| D85N | D[85]N | 7.3E+07 | 2.8E+07 | 38% | 164% | 15 |
| T148A | T[148]A | 4.0E+07 | 2.5E+07 | 62% | 89% | 30 |
| T148A† | T[148]A† | 2.3E+07 | 7.6E+06 | 33% | 52% | 7 |
| K5A | K[5]A | 5.6E+07 | 4.5E+06 | 8% | 125% | 2 |
| D64N | D[64]N | 1.0E+07 | 1.9E+06 | 19% | 22% | 2 |

TABLE 14-continued

Catalytic activity of FIXa variants ($k_{cat}/K_M$)

| Mutation (Mature FIX Numbering) | Mutation (Chymotrypsin Numbering) | $k_{cat}/K_M$ ($M^{-1}s^{-1}$) | ±S.D. ($M^{-1}s^{-1}$) | % CV | % of WT $k_{cat}/K_M$ | n |
|---|---|---|---|---|---|---|
| D64A | D[64]A | 2.5E+06 | 1.1E+06 | 47% | 5% | 2 |
| N167D | N[167]D | 3.1E+07 | 1.1E+07 | 34% | 69% | 2 |
| N167Q | N[167]Q | 3.5E+07 | 1.9E+07 | 53% | 79% | 4 |
| S61A | S[61]A | 4.8E+07 | 2.5E+07 | 52% | 108% | 4 |
| S53A | S[53]A | 3.5E+07 | 1.7E+07 | 48% | 78% | 3 |
| T159A | T[159]A | 3.7E+07 | 1.2E+07 | 33% | 82% | 3 |
| T169A | T[169]A | 4.7E+07 | 2.0E+07 | 43% | 106% | 3 |
| T172A | T[172]A | 5.0E+07 | 2.6E+07 | 52% | 112% | 3 |
| T179A | T[179]A | 5.5E+07 | 1.3E+07 | 23% | 122% | 3 |
| Y155H | Y[155]H | 5.0E+07 | 1.4E+07 | 27% | 113% | 3 |
| Y155Q | Y[155]Q | 5.4E+07 | 2.0E+07 | 36% | 121% | 3 |
| S158A | S[158]A | 3.6E+07 | 1.1E+06 | 3% | 81% | 2 |
| S158D | S[158]D | 4.0E+07 | 9.3E+05 | 2% | 89% | 2 |
| S158E | S[158]E | 3.7E+07 | 3.5E+06 | 9% | 82% | 2 |
| N157Q | N[157]Q | 3.2E+07 | 2.8E+06 | 9% | 72% | 2 |
| D203N/F205T | D39N/F41T | 2.2E+07 | 1.2E+07 | 53% | 50% | 12 |
| D85N/D203N/F205T | D[85]N/D39N/F41T | 3.0E+07 | 6.4E+06 | 22% | 66% | 5 |
| K228N | K63N | 3.6E+07 | 1.7E+07 | 49% | 80% | 13 |
| D85N/K228N | D[85]N/K63N | 4.6E+07 | 1.5E+07 | 32% | 104% | 6 |
| A103N/N105S/K228N | A[103]N/N[105]S/K63N | 2.9E+07 | 1.0E+07 | 35% | 64% | 3 |
| D104N/K106S/K228N | D[104]N/K[106]S/K63N | 2.6E+07 | 7.6E+06 | 29% | 59% | 3 |
| Y155F/K228N | Y[155]F/K63N | 4.5E+07 | 2.4E+06 | 5% | 101% | 2 |
| DIO4N/K106S/Y155F/K228N | D[104]N/K[106]S/Y[155]F/K63N | 5.9E+07 | 1.1E+07 | 19% | 132% | 2 |
| 1251 S | I86S | 5.9E+07 | 1.2E+07 | 21% | 132% | 13 |
| D85N/I251S | D[85]N/I86S | 5.6E+07 | 1.1E+07 | 20% | 124% | 5 |
| D85N/D104N/K106S/I251S | D[85]N/D[104]N/K[106]S/I86S | 3.3E+07 | 6.4E+06 | 19% | 75% | 5 |
| A103N/N105S/I251S | A[103]N/N[105]S/I86S | 3.9E+07 | 2.6E+07 | 67% | 87% | 3 |
| D104N/K106S/I251S | D[104]N/K[106]S/I86S | 2.9E+07 | 1.1E+06 | 4% | 66% | 2 |
| Y155F/I251S | Y[155]F/I86S | 6.7E+07 | 5.9E+06 | 9% | 149% | 2 |
| A262S | A95bS | 2.4E+07 | 1.0E+07 | 42% | 54% | 8 |
| K413N | K243N | 2.9E+07 | 1.7E+07 | 58% | 64% | 5 |
| E410N | E240N | 1.3E+08 | 8.6E+07 | 65% | 297% | 21 |
| E410N* | E240N* | 3.0E+07 | 1.1E+07 | 36% | 66% | 11 |
| E239N | E74N | 2.0E+07 | 1.1E+07 | 58% | 44% | 9 |
| T241N/H243S | T76N/H78S | 1.9E+07 | 5.7E+05 | 3% | 42% | 2 |
| K247N/N249S | K82N/N84S | 5.4E+07 | 1.7E+07 | 32% | 122% | 11 |
| Y155F/K247N/N249S | Y[155]F/K82N/N84S | 5.1E+07 | 9.6E+06 | 19% | 113% | 4 |
| A103N/N105S/K247N/N249S | A[103]N/N[105]S/K82N/N84S | 4.0E+07 | 5.2E+06 | 13% | 90% | 6 |
| D104N/K106S/K247N/N249S | D[104]N/K[106]S/K82N/N84S | 3.2E+07 | 3.3E+06 | 100/0 | 72% | 2 |
| D104N/K106S/Y155F/K247N/N249S | D[104]N/K[106]S/Y[155]F/K82N/N84S | 3.2E+07 | 1.1E+07 | 36% | 71% | 3 |
| L321N | L153N | 1.6E+07 | 2.0E+06 | 13% | 35% | 2 |
| F314N/H315S | F145N/H147S | No Activity | n.d. | n.d. | 0% | 4 |
| S319N/L321S | S151N/L153S | 2.8E+07 | 2.2E+07 | 78% | 64% | 3 |
| N260S | N95S | 1.8E+07 | 1.2E+07 | 66% | 39% | 13 |
| D104N/K106S/N260S | D[104]N/K[106]S/N95S | 1.3E+07 | 6.6E+06 | 51% | 29% | 2 |
| Y155F/N260S | Y[155]F/N95S | 1.9E+07 | 1.6E+07 | 83% | 43% | 2 |
| D104N/K106S/Y155F/N260S | D[104]N/K[106]S/Y[155]F/N95S | 4.3E+06 | 2.0E+06 | 46% | 10% | 2 |
| Y284N | Y117N | 3.5E+07 | 1.5E+07 | 42% | 78% | 8 |
| G317N | G149N | No Activity | n.d. | n.d. | 0% | 5 |
| R318N/A320S | R150N/A152S | No Activity | n.d. | n.d. | 0% | 8 |
| R318A | R150A | 4.9E+07 | 7.4E+06 | 15% | 108% | 3 |
| R318E | R150E | 1.7E+07 | 4.2E+06 | 25% | 38% | 3 |
| R318Y | R150Y | 7.0E+07 | 7.0E+06 | 10% | 156% | 3 |
| R312Q | R143Q | 1.1E+07 | 1.8E+06 | 17% | 23% | 3 |
| R312A | R143A | 4.6E+06 | 9.3E+05 | 20% | 10% | 2 |
| R312Y | R143Y | 1.2E+07 | 4.2E+06 | 36% | 27% | 2 |
| R312L | R143L | 2.4E+07 | 9.4E+06 | 39% | 54% | 2 |
| V202M | V38M | 6.6E+07 | 2.6E+07 | 39% | 148% | 2 |
| V202Y | V38Y | 2.5E+07 | 1.6E+06 | 6% | 56% | 2 |
| D203M | D39M | 4.5E+07 | 1.9E+07 | 42% | 101% | 5 |
| D203Y | D39Y | 3.0E+07 | 2.8E+06 | 9% | 67% | 4 |
| A204M | A40M | 1.8E+07 | 1.2E+07 | 67% | 40% | 5 |
| A204Y | A40Y | 4.6E+07 | 7.6E+06 | 16% | 103% | 2 |

TABLE 14-continued

Catalytic activity of FIXa variants ($k_{cat}/K_M$)

| Mutation (Mature FIX Numbering) | Mutation (Chymotrypsin Numbering) | $k_{cat}/K_M$ ($M^{-1}s^{-1}$) | ±S.D. ($M^{-1}s^{-1}$) | % CV | % of WT $k_{cat}/K_M$ | n |
|---|---|---|---|---|---|---|
| K400A/R403A | K230A/R233A | 5.3E+06 | 6.9E+05 | 13% | 12% | 2 |
| K400E/R403E | K230E/R233E | No Activity | n.d. | n.d. | 0% | 4 |
| R403A | R233A | 1.4E+07 | 3.0E+06 | 22% | 31% | 7 |
| R403E | R233E | 5.5E+06 | 1.5E+06 | 28% | 12% | 6 |
| K400A | K230A | 2.0E+07 | 3.1E+06 | 16% | 44% | 2 |
| K400E | K230E | 9.5E+06 | 1.1E+06 | 12% | 21% | 2 |
| K293E | K126E | 8.1E+06 | 5.4E+05 | 7% | 18% | 2 |
| K293A | K126A | 2.1E+07 | 4.4E+06 | 21% | 46% | 2 |
| R333A | R165A | No Activity | n.d. | n.d. | 0% | 2 |
| R333E | R165E | No Activity | n.d. | n.d. | 0% | 2 |
| R338A | R170A | 1.6E+08 | 2.5E+07 | 15% | 361% | 2 |
| R338E | R170E | 1.8E+08 | 8.3E+07 | 45% | 408% | 10 |
| R338A/R403A | R170A/R233A | 5.3E+07 | 1.3E+07 | 24% | 119% | 6 |
| R338E/R403E | R170E/R233E | 6.2E+07 | 8.8E+06 | 14% | 138% | 2 |
| K293A/R403A | K126A/R233A | 5.7E+06 | 1.4E+06 | 25% | 13% | 2 |
| K293E/R403E | K126E/R233E | 1.3E+06 | 8.5E+04 | 6% | 3% | 2 |
| K293A/R338A/R403A | K126A/R170A/R233A | 2.5E+07 | 9.5E+06 | 39% | 55% | 2 |
| K293E/R338E/R403E | K126E/R170E/R233E | 1.7E+07 | 5.7E+05 | 3% | 37% | 2 |
| R318A/R403A | R150A/R233A | 1.5E+07 | 1.3E+06 | 9% | 33% | 2 |
| R318E/R403E | R150E/R233E | 1.2E+06 | 3.8E+05 | 33% | 3% | 2 |
| R318Y/E410N | R150Y/E240N | 7.5E+07 | 2.7E+07 | 35% | 168% | 21 |
| R338E/E410N | R170E/E240N | 4.6E+08 | 1.7E+08 | 38% | 1018% | 8 |
| R338E/R403E/E410N | R170E/R233E/E240N | 7.8E+07 | 3.7E+07 | 47% | 175% | 7 |
| R318Y/R338E/R403E | R150Y/R170E/R233E | 6.5E+07 | 4.6E+06 | 7% | 145% | 2 |
| D203N/F205T/K228N | D39N/F41T/K63N | 1.4E+07 | 2.5E+06 | 18% | 31% | 2 |
| D203N/F205T/E410N | D39N/F4IT/E240N | 4.2E+07 | 1.7E+07 | 40% | 94% | 6 |
| D203N/F205T/R338E | D39N/F41T/R170E | 1.0E+08 | 2.3E+07 | 22% | 234% | 2 |
| D203N/F205T/R338A | D39N/F41T/R170A | 6.2E+07 | 1.4E+07 | 22% | 139% | 3 |
| D203N/F205T/R318Y | D39N/F41T/R150Y | 2.0E+07 | 2.5E+06 | 12% | 45% | 4 |
| D203N/F205T/R338E/R403E | D39N/F41T/R170E/R233E | 1.9E+07 | 4.8E+06 | 25% | 42% | 2 |
| K228N/E410N | K63N/E240N | 8.5E+07 | 3.4E+07 | 40% | 190% | 10 |
| K228N/R338E | K63N/R170E | 2.1E+08 | 6.1E+07 | 29% | 469% | 2 |
| K228N/R338A | K63N/R170A | 2.1E+08 | 4.6E+07 | 22% | 473% | 2 |
| K228N/R318Y | K63N/R150Y | 4.7E+07 | 6.5E+06 | 14% | 105% | 5 |
| K228N/R338E/R403E | K63N/R170E/R233E | 4.8E+07 | 8.6E+06 | 18% | 108% | 2 |
| R403E/E410N | R233E/E240N | 2.1E+07 | 1.7E+06 | 8% | 47% | 2 |
| R318Y/R338E/E410N | R150Y/R170E/E240N | 3.4E+08 | 1.4E+08 | 39% | 770% | 26 |
| D104N/K106S/R318Y/R338E/E410N | D[104]N/K[106]S/R150Y/R170E/E240N | 2.6E+08 | 5.9E+07 | 23% | 581% | 4 |
| Y155F/R318Y/R338E/E410N | Y[155]F/R150Y/R170E/E240N | 3.7E+08 | 1.3E+08 | 33% | 835% | 5 |
| K228N/R318Y/E410N | K63N/R150Y/E240N | 1.2E+08 | 2.6E+07 | 22% | 272% | 4 |
| R318Y/R403E/E410N | R150Y/R233E/E240N | 2.7E+07 | 3.8E+06 | 14% | 59% | 3 |
| R318Y/R338E/R403E/E410N | R150Y/R170E/R233E/E240N | 1.2E+08 | 8.1E+07 | 69% | 262% | 14 |
| A103N/N105S/R318Y/R338E/R403E/E410N | A[103]N/N[105]S/R150Y/R170E/R233E/E240N | 1.5E+08 | 7.3E+07 | 50% | 327% | 5 |
| D104N/K106S/R318Y/R338E/R403E/E410N | D[104]N/K[106]S/R150Y/R170E/R233E/E240N | 1.7E+08 | 7.9E+07 | 47% | 377% | 3 |
| Y155F/R318Y/R338E/R403E/E410N | Y[155]F/R150Y/R170E/R233E/E240N | 1.9E+08 | 5.0E+07 | 27% | 418% | 4 |
| A103N/N105S/Y155F/R318Y/R338E/R403E/E410N | A[103]N/N[105]S/Y[155]F/R150Y/R170E/R233E/E240N | 1.3E+08 | 1.8E+06 | 1% | 283% | 2 |
| D104N/K106S/Y155F/R318Y/R338E/R403E/E410N | D[104]N/K[106]S/Y[155]F/R150Y/R170E/R233E/E240N | 1.8E+08 | 9.1E+06 | 5% | 394% | 2 |
| D203N/F205T/R318Y/E410N | D39N/F41T/R150Y/E240N | 3.9E+07 | 2.0E+07 | 52% | 88% | 6 |
| R333S | R165S | 1.1E+05 | 5.5E+04 | 51% | 0.2% | 3 |
| R338L | R170L | 2.0E+08 | 2.3E+07 | 11% | 444% | 3 |
| K316N | K148N | 6.2E+06 | 4.2E+06 | 69% | 14% | 3 |
| K316A | K148A | 6.1E+06 | 8.2E+05 | 13% | 14% | 3 |
| K316E | K I48E | 7.1E+05 | 1.4E+05 | 19% | 2% | 3 |
| K316S | K148S | 3.9E+06 | 6.2E+05 | 16% | 9% | 3 |
| K316M | K148M | 3.1E+07 | 1.4E+07 | 46% | 70% | 3 |
| E239S | E74S | 3.4E+07 | 1.8E+07 | 52% | 75% | 3 |
| E239A | E74A | 4.9E+07 | 6.2E+06 | 13% | 110% | 3 |
| E239R | E74R | 5.6E+07 | 1.1E+07 | 19% | 126% | 3 |
| E239K | E74K | 5.1E+07 | 5.1E+06 | 10% | 114% | 3 |
| H257F | H92F | 4.8E+07 | 6.6E+06 | 14% | 108% | 3 |
| H257Y | H92Y | 3.4E+07 | 9.1E+06 | 27% | 75% | 3 |

TABLE 14-continued

Catalytic activity of FIXa variants ($k_{cat}/K_M$)

| Mutation (Mature FIX Numbering) | Mutation (Chymotrypsin Numbering) | $k_{cat}/K_M$ ($M^{-1}s^{-1}$) | ±S.D. ($M^{-1}s^{-1}$) | % CV | % of WT $k_{cat}/K_M$ | n |
|---|---|---|---|---|---|---|
| H257E | H92E | 2.7E+07 | 1.5E+07 | 57% | 60% | 3 |
| H257S | H92S | 3.5E+07 | 1.3E+07 | 36% | 78% | 3 |
| T412A | T242A | 4.6E+07 | 2.8E+07 | 62% | 103% | 5 |
| T412V | T242V | 5.8E+07 | 3.2E+07 | 55% | 130% | 8 |
| E410N/T412A | E240N/T242A | 8.0E+07 | 1.7E+07 | 21% | 178% | 4 |
| E410N/T412V | E240N/T242V | 8.8E+07 | 2.7E+07 | 30% | 197% | 4 |
| E410Q | E240Q | 1.2E+08 | 7.6E+07 | 63% | 269% | .4 |
| E410S | E240S | 1.1E+08 | 6.6E+07 | 60% | 246% | 12 |
| E410A | E240A | 1.1E+08 | 5.6E+07 | 50% | 248% | 10 |
| E410D | E240D | 6.0E+07 | 1.6E+07 | 27% | 134% | 4 |
| N346D | N178D | 1.9E+07 | 8.5E+06 | 44% | 43% | 4 |
| Y155F/N346D | Y[155]F/N178D | 1.3E+07 | 6.8E+06 | 53% | 29% | 2 |
| N346Y | NI78Y | 9.8E+07 | 2.3E+07 | 24% | 218% | 8 |
| Y345A | Y177A | 1.5E+07 | 6.3E+06 | 43% | 32% | 4 |
| Y345T | Y177T | 5.0E+07 | 2.5E+07 | 50% | 112% | 4 |
| T343R | T175R | 1.7E+08 | 1.1E+08 | 66% | 372% | 9 |
| T343E | T175E | 4.0E+07 | 2.3E+07 | 58% | 88% | 4 |
| T343Q | T175Q | 7.1E+07 | 2.2E+07 | 30% | 159% | 3 |
| F342I | F174I | 5.4E+07 | 2.9E+07 | 54% | 121% | 3 |
| T343R/Y345T | T175R/Y177T | 9.3E+07 | 1.8E+07 | 19% | 208% | 3 |
| R318Y/R338E | R150Y/R170E | 1.5E+08 | 5.3E+07 | 36% | 331% | 4 |
| Y259F/K265T/Y345T | Y94F/K98T/Y177T | 5.6E+07 | 1.2E+07 | 21% | 126% | 2 |
| K228N/I251S | K63N/I86S | 2.2E+07 | 5.7E+05 | 3% | 50% | 2 |
| K228N/R318Y/R338E/R403E/E410N | K63N/R150Y/R170E/R233E/E240N | 1.6E+08 | 6.1E+07 | 39% | 349% | 3 |
| Y155F/K228N/R318Y/R338E/R403E/E410N | Y[155]F/K63N/R150Y/R170E/R233E/E240N | 2.0E+08 | 9.3E+06 | 5% | 453% | 2 |
| D85N/K228N/R318Y/R338E/R403E/E410N | D[85]N/K63N/R150Y/R170E/R233E/E240N | 1.6E+08 | 2.3E+07 | 15% | 346% | 2 |
| I251S/R318Y/R338E/R403E/E410N | I86S/R150Y/R170E/R233E/E240N | 1.5E+08 | 4.2E+07 | 27% | 344% | 4 |
| D104N/K106S/I251S/R318Y/R338E/R403E/E410N | D[104]N/K[106]S/I86S/R150Y/R170E/R233E/E240N | 1.2E+08 | 2.0E+07 | 16% | 271% | 8 |
| Y155F/I251S/R318Y/R338E/R403E/E410N | Y[155]F/I86S/R150Y/R170E/R233E/E240N | 1.7E+08 | 9.2E+06 | 6% | 374% | 2 |
| I251S/R318Y/R338E/E410N | I86S/R150Y/R170E/E240N | 3.8E+08 | 6.1E+07 | 16% | 851% | 7 |
| D104N/K106S/I251 S/R318Y/R338E/E410N | D[104]N/K[106]S/I86S/R150Y/R170E/E240N | 1.3E+08 | 3.2E+07 | 24% | 300% | 3 |
| F314N/K316S | F145N/K148S | 8.8E+04 | 8.2E+04 | 94% | 0.2% | 2 |
| K247N/N249S/R318Y/R338E/R403E/E410N | K82N/N84S/R150Y/R170E/R233E/E240N | 1.5E+08 | 4.7E+07 | 30% | 341% | 6 |
| Y155F/K247N/N249S/R318Y/R338E/R403E/E410N | Y[155]F/K82N/N84S/R150Y/R170E/R233E/E240N | 1.8E+08 | 6.1E+07 | 33% | 408% | 6 |
| A103N/N105 S/K247N/N249S/R318Y/R338E/R403E/E410N | A[103]N/N[105]S/K82N/N84S/R150Y/R170E/R233E/E240N | 1.0E+08 | 7.6E+06 | 7% | 232% | 2 |
| D104N/K106S/K247N/N249S/R318Y/R338E/R403E/E410N | D[104]N/K[106]S/K82N/N84S/R150Y/R170E/R233E/E240N | 8.8E+07 | 6.5E+06 | 7% | 197% | 2 |
| K247N/N249S/R318Y/R338E/E410N | K82N/N84S/R150Y/R170E/E240N | 2.3E+08 | 6.6E+07 | 28% | 516% | 6 |
| Y155F/K247N/N249S/R318Y/R338E/E410N | Y[155]F/K82N/N84S/R150Y/R170E/E240N | 3.0E+08 | 1.3E+08 | 42% | 674% | 7 |
| R318Y/R338E/R403E/E410S | R150Y/R170E/R233E/E240S | 1.8E+08 | 6.2E+07 | 34% | 401% | 4 |
| R318Y/R338E/E410S | R150Y/R170E/E240S | 3.3E+08 | 1.2E+08 | 37% | 730% | 8 |
| K228N/K247N/N249S | K63N/K82N/N84S | 3.8E+07 | 1.2E+07 | 32% | 86% | 2 |
| D104N/K106S/Y155F/K228N/K247N/N249S | D[104]N/K[106]S/Y[155]F/K63N/K82N/N84S | 6.3E+07 | 3.3E+06 | 5% | 142% | 2 |
| D104N/K106S/K228N/K247N/N249S | D[104]N/K[106]S/K63N/K82N/N84S | 2.3E+07 | 1.1E+07 | 48% | 51% | 5 |
| Y155F/K228N/K247N/N249S | Y[155]F/K63N/K82N/N84S | 5.3E+07 | 5.5E+06 | 10% | 118% | 2 |
| K228N/K247N/N249S/R318Y/R338E/R403E/E410N | K63N/K82N/N84S/R150Y/R170E/R233E/E240N | 1.2E+08 | 3.8E+07 | 33% | 258% | 3 |
| R318Y/R338E/R403E/E410N/T412V | R150Y/R170E/R233E/E240N/T242V | 1.9E+08 | 5.0E+07 | 26% | 424% | 4 |
| R318Y/R338E/R403E/E410N/T412A | R150Y/R170E/R233E/E240N/T242A | 2.6E+08 | 7.4E+07 | 29% | 577% | 4 |
| R318Y/R338E/R403E/T412A | R150Y/R170E/R233E/T242A | 8.0E+07 | 3.4E+07 | 42% | 178% | 4 |

TABLE 14-continued

Catalytic activity of FIXa variants ($k_{cat}/K_M$)

| Mutation (Mature FIX Numbering) | Mutation (Chymotrypsin Numbering) | $k_{cat}/K_M$ ($M^{-1}s^{-1}$) | ±S.D. ($M^{-1}s^{-1}$) | % CV | % of WT $k_{cat}/K_M$ | n |
|---|---|---|---|---|---|---|
| R318Y/R338E/T412A | R150Y/R170E/T242A | 3.0E+08 | 8.3E+07 | 28% | 661% | 6 |
| R318Y/R338E/E410N/T412V | R150Y/R170E/E240N/T242V | 2.4E+08 | 1.4E+08 | 60% | 536% | 4 |
| N260S/R318Y/R338E/R403E/E410N | N95S/R150Y/R170E/R233E/E240N | 5.3E+07 | 6.6E+05 | 1% | 117% | 2 |
| D104N/K106S/N260S/R318Y/R338E/R403E/E410N | D[104]N/K[106]S/N95S/R150Y/R170E/R233E/E240N | 8.8E+07 | 7.9E+06 | 9% | 196% | 2 |
| Y155F/N260S/R318Y/R338E/R403E/E410N | Y[155]F/N95S/R150Y/R170E/R233E/E240N | 7.0E+07 | 2.4E+07 | 35% | 156% | 2 |
| R318Y/R338E/N346D/R403E/E410N | R150Y/R170E/N178D/R233E/E240N | 3.1E+07 | 9.1E+06 | 30% | 68% | 2 |
| Y155F/R318Y/R338E/N346D/R403E/E410N | Y[155]F/R150Y/R170E/N178D/R233E/E240N | 6.2E+07 | 1.8E+07 | 30% | 139% | 2 |
| K247N/N249S/N260S | K82N/N84S/N95S | 2.9E+07 | 2.6E+06 | 9% | 64% | 2 |
| Y155F/K247N/N249S/N260S | Y[155]F/K82N/N84S/N95S | 1.9E+07 | 4.2E+06 | 22% | 43% | 2 |
| D104N/K106S/K247N/N249S/N260S | D[104]N/K[106]S/K82N/N84S/N95S | 9.8E+06 | 3.0E+06 | 30% | 22% | 2 |
| D104N/K106S/Y155F/K247N/N249S/N260S | D[104]N/K[106]S/Y[155]F/K82N/N84S/N95S | 8.2E+06 | 3.9E+06 | 47% | 18% | 2 |
| K247N/N249S/N260S/R318Y/R338E/R403E/E410N | K82N/N84S/N95S/R150Y/R170E/R233E/E240N | 9.7E+07 | 8.7E+06 | 9% | 217% | 2 |
| Y155F/N260S/N346D | Y[155]F/N95S/N178D | 2.2E+06 | 7.4E+05 | 34% | 5% | 2 |
| R318Y/R338E/T343R/R403E/E410N | R150Y/R170E/T175R/R233E/E240N | 5.4E+08 | 1.6E+08 | 29% | 1217% | 3 |
| R338E/T343R | R170E/T175R | 6.0E+08 | 1.7E+08 | 29% | 1329% | 4 |

†produced in BHK-21 cells;
*80% glycosylated form of E410N

TABLE 15

Catalytic activity of FIXa variants ($k_{cat}/K_M$)

| Mutation (Mature FIX Numbering) | Mutation (Chymotrypsin Numbering) | $k_{cat}/K_M$ ($M^{-1}s^{-1}$) | ±S.D. ($M^{-1}s^{-1}$) | % CV | % of WT $k_{cat}/K_M$ | n |
|---|---|---|---|---|---|---|
| BeneFIX Benefix ® Coagulation FIX (T148A) | BeneFIX Benefix ® Coagulation FIX (T[148]A) | 4.3E+07 | 2.3E+07 | 54% | 92% | 140 |
| Plasma Purified FIXa | Plasma Purified FIXa | 5.6E+07 | 2.6E+07 | 46% | 122% | 200 |
| Catalyst Biosciences WT | Catalyst Biosciences WT | 4.6E+07 | 2.5E+07 | 54% | 100% | 33 |
| N157D | N[157]D | 2.9E+07 | 8.1E+06 | 28% | 62% | 2 |
| Y155F | Y[155]F | 4.1E+07 | 1.3E+05 | 0% | 90% | 2 |
| A103N/N105S/Y155F | A[103]N/N[105]S/Y[155]F | 3.9E+07 | 1.4E+06 | 4% | 85% | 2 |
| D104N/K106S/Y155F | D[104]N/K[106]S/Y[155]F | 3.6E+07 | 1.0E+06 | 3% | 78% | 2 |
| A103N/N105S | A[103]N/N[105]S | 3.7E+07 | 1.4E+07 | 38% | 80% | 9 |
| D104N/K106S | D[104]N/K[106]S | 3.8E+07 | 1.3E+07 | 34% | 83% | 9 |
| K106N/V108S | K[106]N/V[108]S | 2.8E+07 | 6.7E+06 | 24% | 60% | 7 |
| D85N | D[85]N | 7.0E+07 | 2.7E+07 | 39% | 153% | 17 |
| T148A | T[148]A | 4.0E+07 | 2.2E+07 | 54% | 88% | 44 |
| T148A† | T[148]A† | 2.3E+07 | 7.6E+06 | 33% | 50% | 7 |
| K5A | K[5]A | 5.5E+07 | 9.3E+06 | 17% | 120% | 4 |
| D64N | D[64]N | 1.0E+07 | 1.9E+06 | 19% | 22% | 2 |
| D64A | D[64]A | 2.5E+06 | 1.1E+06 | 47% | 5% | 2 |
| N167D | N[167]D | 3.1E+07 | 1.1E+07 | 34% | 67% | 2 |
| N167Q | N[167]Q | 3.5E+07 | 1.9E+07 | 53% | 76% | 4 |
| S61A | S[61]A | 4.8E+07 | 2.5E+07 | 52% | 105% | 4 |
| S53A | S[53]A | 3.5E+07 | 1.7E+07 | 48% | 76% | 3 |
| T159A | T[159]A | 3.7E+07 | 1.2E+07 | 33% | 80% | 3 |
| T169A | T[169]A | 4.7E+07 | 2.0E+07 | 43% | 103% | 3 |
| T172A | T[172]A | 5.0E+07 | 2.6E+07 | 52% | 109% | 3 |
| T179A | T[179]A | 5.5E+07 | 1.3E+07 | 23% | 119% | 3 |
| Y155H | Y[155]H | 5.0E+07 | 1.4E+07 | 27% | 109% | 3 |
| Y155Q | Y[155]Q | 5.4E+07 | 2.0E+07 | 36% | 117% | 3 |
| S158A | S[158]A | 3.6E+07 | 1.1E+06 | 3% | 79% | 2 |
| S158D | S[158]D | 4.0E+07 | 9.3E+05 | 2% | 86% | 2 |
| S158E | S[158]E | 3.7E+07 | 3.5E+06 | 9% | 80% | 2 |
| N157Q | N[157]Q | 3.2E+07 | 2.8E+06 | 9% | 70% | 2 |
| D203/F205T | D39N/F41T | 2.2E+07 | 1.2E+07 | 53% | 49% | 12 |
| D85N/D203N/F205T | D[85]N/D39N/F41T | 3.0E+07 | 6.4E+06 | 22% | 64% | 5 |
| K228N | K63N | 3.6E+07 | 1.7E+07 | 49% | 77% | 13 |

TABLE 15-continued

Catalytic activity of FIXa variants ($k_{cat}/K_M$)

| Mutation (Mature FIX Numbering) | Mutation (Chymotrypsin Numbering) | $k_{cat}/K_M$ ($M^{-1}s^{-1}$) | ±S.D. ($M^{-1}s^{-1}$) | % CV | % of WT $k_{cat}/K_M$ | n |
|---|---|---|---|---|---|---|
| D85N/K228N | D[85]N/K63N | 4.6E+07 | 1.5E+07 | 32% | 101% | 6 |
| A103N/N105S/K228N | A[103]N/N[105]S/K63N | 2.9E+07 | 1.0E+07 | 35% | 63% | 3 |
| D104N/K106S/K228N | D[104]N/K[106]S/K63N | 2.6E+07 | 7.6E+06 | 29% | 57% | 3 |
| Y155F/K228N | Y[155]F/K63N | 4.5E+07 | 2.4E+06 | 5% | 98% | 2 |
| D104N/K106S/Y155F/K228N | D[104]N/K[106]S/Y[155]F/K63N | 5.9E+07 | 1.1E+07 | 19% | 129% | 2 |
| I251S | I86S | 5.9E+07 | 1.2E+07 | 21% | 128% | 13 |
| D85N/I251S | D[85]N/I86S | 5.6E+07 | 1.1E+07 | 20% | 121% | 5 |
| D85N/D104N/K106S/I251S | D[85]N/D[104]N/K[106]S/I86S | 3.3E+07 | 6.4E+06 | 19% | 73% | 5 |
| A103N/N105S/I251S | A[103]N/N[105]S/I86S | 3.9E+07 | 2.6E+07 | 67% | 84% | 3 |
| D104N/K106S/I251S | D[104]N/K[106]S/I86S | 2.9E+07 | 1.1E+06 | 4% | 64% | 2 |
| Y155F/I251S | Y[155]F/I86S | 6.7E+07 | 5.9E+06 | 9% | 145% | 2 |
| A262S | A95bS | 2.4E+07 | 1.0E+07 | 42% | 52% | 8 |
| K413N | K243N | 2.8E+07 | 1.4E+07 | 51% | 60% | 7 |
| E410N | E240N | 1.3E+08 | 7.7E+07 | 60% | 277% | 27 |
| E410N* | E240N* | 3.0E+07 | 1.1E+07 | 36% | 65% | 10 |
| E239N | E74N | 2.0E+07 | 1.1E+07 | 58% | 43% | 9 |
| T241N/H243S | T76N/H78S | 1.9E+07 | 5.7E+05 | 3% | 41% | 2 |
| K247N/N249S | K82N/N84S | 5.4E+07 | 1.7E+07 | 32% | 118% | 11 |
| Y155F/K247N/N249S | Y[155]F/K82N/N84S | 5.1E+07 | 9.6E+06 | 19% | 110% | 4 |
| A103N/N105S/K247N/N249S | A[103]N/N[105]S/K82N/N84S | 4.0E+07 | 5.2E+06 | 13% | 87% | 6 |
| D104N/K106S/K247N/N249S | D[104]N/K[106]S/K82N/N84S | 3.2E+07 | 3.3E+06 | 10% | 69% | 2 |
| D104N/K106S/Y155F/K247N/N249S | D[104]N/K[106]S/Y[155]F/K82N/N84S | 3.2E+07 | 1.1E+07 | 36% | 69% | 3 |
| L321N | L153N | 1.6E+07 | 2.0E+06 | 13% | 34% | 2 |
| F314N/H315S | F145N/H147S | 4.4E+05 | 3.7E+04 | 8% | 1% | 2 |
| K392N/K394S | K222N/K224S | 0.0E+00 | n.d. | n.d. | 0% | 0 |
| S319N/L321S | S151N/L153S | 2.8E+07 | 2.2E+07 | 78% | 62% | 3 |
| N260S | N95S | 1.8E+07 | 1.2E+07 | 66% | 38% | 13 |
| D104N/K106S/N260S | D[104]N/K[106]S/N95S | 1.3E+07 | 6.6E+06 | 51% | 28% | 2 |
| Y155F/N260S | Y[155]F/N95S | 1.9E+07 | 1.6E+07 | 83% | 42% | 2 |
| D104N/K106S/Y155F/N260S | D[104]N/K[106]S/Y[155]F/N95S | 4.3E+06 | 2.0E+06 | 46% | 9% | 2 |
| Y284N | Y117N | 3.5E+07 | 1.5E+07 | 42% | 76% | 8 |
| G317N | G149N | 4.6E+04 | n.d. | n.d. | 0% | 1 |
| R318N/A320S | R150N/A152S | 2.3E+05 | 2.1E+05 | 89% | 1% | 3 |
| R318A | R150A | 4.5E+07 | 6.4E+06 | 14% | 98% | 2 |
| R318E | R150E | 1.7E+07 | 4.2E+06 | 25% | 37% | 3 |
| R318Y | R150Y | 7.0E+07 | 7.0E+06 | 10% | 151% | 3 |
| R312Q | R143Q | 1.1E+07 | 1.8E+06 | 17% | 23% | 3 |
| R312A | R143A | 4.6E+06 | 9.3E+05 | 20% | 10% | 2 |
| R312Y | R143Y | 1.2E+07 | 4.2E+06 | 36% | 26% | 2 |
| R312L | R143L | 2.4E+07 | 9.4E+06 | 39% | 53% | 2 |
| V202M | V38M | 6.6E+07 | 2.6E+07 | 39% | 143% | 2 |
| V202Y | V38Y | 2.5E+07 | 1.6E+06 | 6% | 55% | 2 |
| D203M | D39M | 4.5E+07 | 1.9E+07 | 42% | 98% | 5 |
| D203Y | D39Y | 3.0E+07 | 2.8E+06 | 9% | 65% | 4 |
| A204M | A40M | 1.8E+07 | 1.2E+07 | 67% | 39% | 5 |
| A204Y | A40Y | 4.6E+07 | 7.6E+06 | 16% | 100% | 2 |
| K400A/R403A | K230A/R233A | 5.3E+06 | 6.9E+05 | 13% | 12% | 2 |
| K400E/R403E | K230E/R233E | 4.3E+05 | 3.1E+04 | 7% | 1% | 3 |
| R403A | R233A | 1.4E+07 | 3.0E+06 | 22% | 30% | 7 |
| R403E | R233E | 5.5E+06 | 1.5E+06 | 28% | 12% | 6 |
| K400A | K230A | 2.0E+07 | 3.1E+06 | 16% | 43% | 2 |
| K400E | K230E | 9.5E+06 | 1.1E+06 | 12% | 21% | 2 |
| K293E | K126E | 8.1E+06 | 5.4E+05 | 7% | 17% | 2 |
| K293A | K126A | 2.1E+07 | 4.4E+06 | 21% | 45% | 2 |
| R333A | R165A | 1.6E+05 | 1.1E+04 | 7% | 0% | 2 |
| R333E | R165E | 1.3E+04 | n.d. | n.d. | 0% | 1 |
| R338A | R170A | 1.6E+08 | 2.5E+07 | 15% | 350% | 2 |
| R338E | R170E | 1.8E+08 | 8.3E+07 | 45% | 396% | 10 |
| R338A/R403A | R170A/R233A | 5.3E+07 | 1.3E+07 | 24% | 115% | 6 |
| R338E/R403E | R170E/R233E | 6.2E+07 | 8.8E+06 | 14% | 134% | 2 |
| K293A/R403A | K126A/R233A | 5.7E+06 | 1.4E+06 | 25% | 12% | 2 |
| K293E/R403E | K126E/R233E | 1.3E+06 | 8.5E+04 | 6% | 3% | 2 |
| K293A/R338A/R403A | K126A/R170A/R233A | 2.5E+07 | 9.5E+06 | 39% | 53% | 2 |
| K293E/R338E/R403E | K126E/R170E/R233E | 1.7E+07 | 5.7E+06 | 3% | 36% | 2 |
| R318A/R403A | R150A/R233A | 1.5E+07 | 1.3E+06 | 9% | 32% | 2 |
| R318E/R403E | R150E/R233E | 1.2E+06 | 3.8E+05 | 33% | 3% | 2 |
| R318Y/E410N | R150Y/E240N | 7.5E+07 | 2.7E+07 | 35% | 163% | 21 |
| R338E/E410N | R170E/E240N | 4.4E+08 | 1.5E+08 | 33% | 950% | 12 |
| R338E/R403E/E410N | R170E/R233E/E240N | 1.9E+08 | 1.4E+08 | 72% | 411% | 17 |

TABLE 15-continued

Catalytic activity of FIXa variants ($k_{cat}/K_M$)

| Mutation (Mature FIX Numbering) | Mutation (Chymotrypsin Numbering) | $k_{cat}/K_M$ ($M^{-1}s^{-1}$) | ±S.D. ($M^{-1}s^{-1}$) | % CV | % of WT $k_{cat}/K_M$ | n |
|---|---|---|---|---|---|---|
| Y155F/R338E/R403E/E410N | Y[155]F/R170E/R233E/E240N | 1.8E+08 | 6.0E+07 | 32% | 401% | 2 |
| R318Y/R338E/R403E | R150Y/R170E/R233E | 6.2E+07 | 6.3E+06 | 10% | 134% | 3 |
| Y155F/R318Y/R338E/R403E | Y[155]F/R150Y/R170E/R233E | 8.7E+07 | 5.1E+07 | 58% | 189% | 2 |
| D203N/F205T/K228N | D39N/F41T/K63N | 1.4E+07 | 2.5E+06 | 18% | 30% | 2 |
| D203N/F205T/E410N | D39N/F41T/E240N | 4.2E+07 | 1.7E+07 | 40% | 91% | 6 |
| D203N/F205T/R338E | D39N/F41T/R170E | 1.0E+08 | 2.3E+07 | 22% | 228% | 2 |
| D203N/F205T/R338A | D39N/F41T/R170A | 6.2E+07 | 1.4E+07 | 22% | 135% | 3 |
| D203N/F205T/R318Y | D39N/F41T/R150Y | 2.0E+07 | 2.5E+06 | 12% | 44% | 4 |
| D203N/F205T/R338E/R403E | D39N/F41T/R170E/R233E | 1.9E+07 | 4.8E+06 | 25% | 41% | 2 |
| K228N/E410N | K63N/E240N | 8.5E+07 | 3.4E+07 | 40% | 184% | 10 |
| K228N/R338E | K63N/R170E | 2.1E+08 | 6.1E+07 | 29% | 455% | 2 |
| K228N/R338A | K63N/R170A | 2.1E+08 | 4.6E+07 | 22% | 459% | 2 |
| K228N/R318Y | K63N/R150Y | 4.7E+07 | 6.5E+06 | 14% | 102% | 5 |
| K228N/R338E/R403E | K63N/R170E/R233E | 4.8E+07 | 8.6E+06 | 18% | 105% | 2 |
| R403E/E410N | R233E/E240N | 2.1E+07 | 1.7E+06 | 8% | 46% | 2 |
| R318Y/R338E/E410N | R150Y/R170E/E240N | 3.4E+08 | 1.2E+08 | 37% | 727% | 42 |
| D104N/K106S/R318Y/R338E/E410N | D[104]N/K[106]S/R150Y/R170E/E240N | 2.6E+08 | 5.9E+07 | 23% | 564% | 4 |
| Y155F/R318Y/R338E/E410N | Y[155]F/R150Y/R170E/E240N | 3.7E+08 | 1.3E+08 | 33% | 810% | 5 |
| K228N/R318Y/E410N | K63N/R150Y/E240N | 1.2E+08 | 2.6E+07 | 22% | 264% | 4 |
| R318Y/R403E/E410N | R150Y/R233E/E240N | 2.5E+07 | 4.7E+06 | 19% | 54% | 5 |
| Y155F/R318Y/R403E/E410N | Y[155]F/R150Y/R233E/E240N | 3.6E+07 | 2.9E+07 | 82% | 78% | 2 |
| R318Y/R338E/R403E/E410N | R150Y/R170E/R233E/E240N | 1.5E+08 | 8.2E+07 | 56% | 320% | 26 |
| A103N/N105S/R318Y/R338E/R403E/E410N | A[103]N/N[105]S/R150Y/R170E/R233E/E240N | 1.5E+08 | 7.3E+07 | 50% | 318% | 5 |
| D104N/K106S/R318Y/R338E/R403E/E410N | D[104]N/K[106]S/R150Y/R170E/R233E/E240N | 1.7E+08 | 7.9E+07 | 47% | 366% | 3 |
| Y155F/R318Y/R338E/R403E/E410N | Y[155]F/R150Y/R170E/R233E/E240N | 1.9E+08 | 5.0E+07 | 27% | 406% | 4 |
| A103N/N105S/Y155F/R318Y/R338E/R403E/E410N | A[103]N/N[105]S/Y[155]F/R150Y/R170E/R233E/E240N | 1.3E+08 | 1.8E+06 | 1% | 274% | 2 |
| D104N/K106S/Y155F/R318Y/R338E/R403E/E410N | D[104]N/K[106]S/Y[155]F/R150Y/R170E/R233E/E240N | 1.8E+08 | 9.1E+06 | 5% | 382% | 2 |
| D203N/F205T/R318Y/E410N | D39N/F41T/R150Y/E240N | 3.9E+07 | 2.0E+07 | 52% | 85% | 6 |
| R333S | R165S | 1.1E+05 | 5.5E+04 | 51% | 0% | 3 |
| R338L | R170L | 2.0E+08 | 2.3E+07 | 11% | 431% | 3 |
| K316N | K148N | 6.2E+06 | 4.2E+06 | 69% | 13% | 3 |
| K316A | K148A | 6.1E+06 | 8.2E+05 | 13% | 13% | 3 |
| K316E | K148E | 7.1E+05 | 1.4E+05 | 19% | 2% | 3 |
| K316S | K148S | 3.9E+06 | 6.2E+05 | 16% | 9% | 3 |
| K316M | K148M | 3.1E+07 | 1.4E+07 | 46% | 68% | 3 |
| E239S | E74S | 3.4E+07 | 1.8E+07 | 52% | 73% | 3 |
| E239A | E74A | 4.9E+07 | 6.2E+06 | 13% | 107% | 3 |
| E239R | E74R | 5.6E+07 | 1.1E+07 | 19% | 122% | 3 |
| E239K | E74K | 5.1E+07 | 5.1E+06 | 10% | 111% | 3 |
| H257F | H92F | 4.8E+07 | 6.6E+06 | 14% | 105% | 3 |
| H257Y | H92Y | 3.4E+07 | 9.1E+06 | 27% | 73% | 3 |
| H257E | H92E | 2.7E+07 | 1.5E+07 | 57% | 58% | 3 |
| H257S | H92S | 3.5E+07 | 1.3E+07 | 36% | 76% | 3 |
| T412A | T242A | 4.6E+07 | 2.8E+07 | 62% | 100% | 5 |
| T412V | T242V | 5.8E+07 | 3.2E+07 | 55% | 126% | 8 |
| E410N/T412A | E240N/T242A | 8.0E+07 | 1.7E+07 | 21% | 173% | 4 |
| E410N/T412V | E240N/T242V | 8.8E+07 | 2.7E+07 | 30% | 192% | 4 |
| E410Q | E240Q | 1.2E+08 | 7.6E+07 | 63% | 261% | 4 |
| E410S | E240S | 1.1E+08 | 6.6E+07 | 60% | 239% | 12 |
| E410A | E240A | 1.1E+08 | 5.6E+07 | 50% | 241% | 10 |
| E410D | E240D | 6.0E+07 | 1.6E+07 | 27% | 130% | 4 |
| N346D | N178D | 1.9E+07 | 8.5E+06 | 44% | 42% | 4 |
| Y155F/N346D | Y[155]F/N178D | 1.3E+07 | 6.8E+06 | 53% | 28% | 2 |
| N346Y | N178Y | 9.8E+07 | 2.3E+07 | 24% | 212% | 8 |
| Y345A | Y177A | 1.5E+07 | 6.3E+06 | 43% | 32% | 4 |
| Y345T | Y177T | 5.0E+07 | 2.5E+07 | 50% | 108% | 3 |
| T343R | T175R | 1.4E+08 | 1.0E+08 | 70% | 313% | 12 |
| T343E | T175E | 4.0E+07 | 2.3E+07 | 58% | 86% | 4 |
| T343Q | T175Q | 7.1E+07 | 2.2E+07 | 30% | 154% | 3 |
| F342I | F174I | 5.4E+07 | 2.9E+07 | 54% | 118% | 3 |
| T343R/Y345T | T175R/Y177T | 9.3E+07 | 1.8E+07 | 19% | 202% | 3 |

TABLE 15-continued

Catalytic activity of FIXa variants ($k_{cat}/K_M$)

| Mutation (Mature FIX Numbering) | Mutation (Chymotrypsin Numbering) | $k_{cat}/K_M$ ($M^{-1}s^{-1}$) | ±S.D. ($M^{-1}s^{-1}$) | % CV | % of WT $k_{cat}/K_M$ | n |
|---|---|---|---|---|---|---|
| R318Y/R338E | R150Y/R170E | 1.5E+08 | 5.3E+07 | 36% | 322% | 4 |
| Y259F/K265T/Y345T | Y94F/K98T/Y177T | 5.6E+07 | 1.2E+07 | 21% | 122% | 2 |
| K228N/I251S | K63N/I86S | 2.2E+07 | 5.7E+05 | 3% | 48% | 2 |
| K228N/R318Y/R338E/R403E/E410N | K63N/R150Y/R170E/R233E/E240N | 1.6E+08 | 6.1E+07 | 39% | 339% | 3 |
| Y155F/K228N/R318Y/R338E/R403E/E410N | Y[155]F/K63N/R150Y/R170E/R233E/E240N | 1.6E+08 | 4.1E+07 | 25% | 356% | 5 |
| D85N/K228N/R318Y/R338E/R403E/E410N | D[85]N/K63N/R150Y/R170E/R233E/E240N | 1.6E+08 | 2.3E+07 | 15% | 336% | 2 |
| I251S/R318Y/R338E/R403E/E410N | I86S/R150Y/R170E/R233E/E240N | 1.5E+08 | 4.2E+07 | 27% | 334% | 4 |
| D104N/K106S/I251S/R318Y/R338E/R403E/E410N | D[104]N/K[106]S/I86S/R150Y/R170E/R233E/E240N | 1.2E+08 | 2.0E+07 | 16% | 263% | 8 |
| Y155F/I251S/R318Y/R338E/R403E/E410N | D[104]N/K[106]S/I86S/R150Y/R170E/R233E/E240N | 1.7E+08 | 9.2E+06 | 6% | 363% | 2 |
| I251S/R318Y/R338E/E410N | I86S/R150Y/R170E/E240N | 3.9E+08 | 7.4E+07 | 19% | 849% | 10 |
| D104N/K106S/I251S/R318Y/R338E/E410N | D[104]N/K[106]S/I86S/R150Y/R170E/E240N | 1.3E+08 | 3.2E+07 | 24% | 291% | 3 |
| F314N/K316S | F145N/K148S | 8.8E+04 | 8.2E+04 | 94% | 0% | 2 |
| K247N/N249S/R318Y/R338E/R403E/E410N | K82N/N84S/R150Y/R170E/R233E/E240N | 1.5E+08 | 4.7E+07 | 30% | 331% | 6 |
| Y155F/K247N/N249S/R318Y/R338E/R403E/E410N | Y[155]F/K82N/N84S/R150Y/R170E/R233E/E240N | 1.9E+08 | 5.7E+07 | 30% | 405% | 10 |
| A103N/N105S/K247N/N249S/R318Y/R338E/R403E/E410N | A[103]N/N[105]S/K82N/N84S/R150Y/R170E/R233E/E240N | 1.5E+08 | 4.2E+07 | 28% | 324% | 6 |
| D104N/K106S/K247N/N249S/R318Y/R338E/R403E/E410N | D[104]N/K[106]S/K82N/N84S/R150Y/R170E/R233E/E240N | 8.8E+07 | 6.5E+06 | 7% | 192% | 2 |
| D104N/K106S/Y155F/K247N/N249S/R318Y/R338E/R403E/E410N | D[104]N/K[106]S/Y[155]F/K82N/N84S/R150Y/R170E/R233E/E240N | 1.3E+08 | 7.3E+07 | 54% | 292% | 6 |
| K247N/N249S/R318Y/R338E/E410N | K82N/N84S/R150Y/R170E/E240N | 2.3E+08 | 6.6E+07 | 28% | 501% | 6 |
| Y155F/K247N/N249S/R318Y/R338E/E410N | Y[155]F/K82N/N84S/R150Y/R170E/E240N | 3.3E+08 | 1.3E+08 | 39% | 717% | 9 |
| R318Y/R338E/R403E/E410S | R150Y/R170E/R233E/E240S | 2.1E+08 | 6.1E+07 | 29% | 458% | 7 |
| R318Y/R338E/E410S | R150Y/R170E/E240S | 3.3E+08 | 1.2E+08 | 37% | 708% | 8 |
| K228N/K247N/N249S | K63N/K82N/N84S | 3.8E+07 | 1.2E+07 | 32% | 83% | 2 |
| D104N/K106S/Y155F/K228N/K247N/N249S | D[104]N/K[106]S/Y[155]F/K63N/K82N/N84S | 6.3E+07 | 3.3E+06 | 5% | 137% | 2 |
| D104N/K106S/K228N/K247N/N249S | D[104]N/K[106]S/K63N/K82N/N84S | 2.3E+07 | 1.1E+07 | 48% | 49% | 5 |
| Y155F/K228N/K247N/N249S | Y[155]F/K63N/K82N/N84S | 5.3E+07 | 5.5E+06 | 10% | 115% | 2 |
| K228N/K247N/N249S/R318Y/R338E/R403E/E410N | K63N/K82N/N84S/R150Y/R170E/R233E/E240N | 1.6E+08 | 8.4E+07 | 51% | 352% | 17 |
| D104N/K106S/K228N/K247N/N249S/R318Y/R338E/R403E/E410N | D[104]N/K[106]S/K63N/K82N/N84S/R150Y/R170E/R233E/E240N | 1.1E+08 | 4.4E+07 | 40% | 239% | 7 |
| Y155F/K228N/K247N/N249S/R318Y/R338E/R403E/E410N | Y[155]F/K63N/K82N/N84S/R150Y/R170E/R233E/E240N | 1.2E+08 | 5.3E+07 | 44% | 263% | 5 |
| R318Y/R338E/R403E/E410N/T412V | R150Y/R170E/R233E/E240N/T242V | 1.6E+08 | 6.3E+07 | 40% | 342% | 6 |
| R318Y/R338E/R403E/E410N/T412A | R150Y/R170E/R233E/E240N/T242A | 2.5E+08 | 9.2E+07 | 37% | 538% | 6 |
| R318Y/R338E/R403E/T412A | R150Y/R170E/R233E/T242A | 8.0E+07 | 3.4E+07 | 42% | 173% | 4 |
| R318Y/R338E/T412A | R150Y/R170E/T242A | 3.0E+08 | 8.3E+07 | 28% | 642% | 6 |
| R318Y/R338E/E410N/T412V | R150Y/R170E/E240N/T242V | 2.6E+08 | 1.2E+08 | 46% | 571% | 11 |
| N260S/R318Y/R338E/R403E/E410N | N95S/R150Y/R170E/R233E/E240N | 5.3E+07 | 6.6E+05 | 1% | 114% | 2 |
| D104N/K106S/N260S/R318Y/R338E/R403E/E410N | D[104]N/K[106]S/N95S/R150Y/R170E/R233E/E240N | 8.8E+07 | 7.9E+06 | 9% | 190% | 2 |
| Y155F/N260S/R318Y/R338E/R403E/E410N | Y[155]F/N95S/R150Y/R170E/R233E/E240N | 7.0E+07 | 2.4E+07 | 35% | 152% | 2 |
| R318Y/R338E/N346D/R403E/E410N | R150Y/R170E/N178D/R233E/E240N | 3.1E+07 | 9.1E+06 | 30% | 66% | 2 |
| Y155F/R318Y/R338E/N346D/R403E/E410N | Y[155]F/R150Y/R170E/N178D/R233E/E240N | 6.2E+07 | 1.8E+07 | 30% | 135% | 2 |

TABLE 15-continued

Catalytic activity of FIXa variants ($k_{cat}/K_M$)

| Mutation (Mature FIX Numbering) | Mutation (Chymotrypsin Numbering) | $k_{cat}/K_M$ ($M^{-1}s^{-1}$) | ±S.D. ($M^{-1}s^{-1}$) | % CV | % of WT $k_{cat}/K_M$ | n |
|---|---|---|---|---|---|---|
| K247N/N249S/N260S | K82N/N84S/N95S | 2.9E+07 | 2.6E+06 | 9% | 62% | 2 |
| Y155F/K247N/N249S/N260S | Y[155]F/K82N/N84S/N95S | 1.9E+07 | 4.2E+06 | 22% | 42% | 2 |
| D104N/K106S/K247N/N249S/N260S | D[104]N/K[106]S/K82N/N84S/N95S | 9.8E+06 | 3.0E+06 | 30% | 21% | 2 |
| D104N/K106S/Y155F/K247N/N249S/N260S | D[104]N/K[106]S/Y[155]F/K82N/N84S/N95S | 8.2E+06 | 3.9E+06 | 47% | 18% | 2 |
| K247N/N249S/N260S/R318Y/R338E/R403E/E410N | K82N/N84S/N95S/R150Y/R170E/R233E/E240N | 6.7E+07 | 2.6E+07 | 38% | 145% | 6 |
| Y155F/K247N/N249S/N260S/R318Y/R338E/R403E/E410N | Y[155]F/K82N/N84S/N95S/R150Y/R170E/R233E/E240N | 5.7E+07 | 3.6E+07 | 64% | 124% | 5 |
| Y155F/N260S/N346D | Y[155]F/N95S/N178D | 2.2E+06 | 7.4E+05 | 34% | 5% | 2 |
| R318Y/R338E/T343R/R403E/E410N | R150Y/R170E/T175R/R233E/E240N | 4.2E+08 | 1.4E+08 | 33% | 907% | 13 |
| Y155F/R318Y/R338E/T343R/R403E/E410N | Y[155]F/R150Y/R170E/T175R/R233E/E240N | 3.0E+08 | 8.3E+07 | 28% | 640% | 4 |
| D104N/K106S/R318Y/R338E/T343R/R403E/E410N | D[104]N/K[106]S/R150Y/R170E/T175R/R233E/E240N | 2.2E+08 | 1.2E+08 | 52% | 487% | 5 |
| R338E/T343R | R170E/T175R | 5.2E+08 | 1.6E+08 | 31% | 1120% | 7 |
| T343R/N346Y | T175R/N178Y | 9.6E+07 | 4.4E+07 | 46% | 208% | 11 |
| R318Y/R338E/N346Y/R403E/E410N | R150Y/R170E/N178Y/R233E/E240N | 1.2E+08 | 2.1E+07 | 16% | 270% | 3 |
| R318Y/R338E/T343R/N346Y/R403E/E410N | R150Y/R170E/T175R/N178Y/R233E/E240N | 3.1E+08 | 1.1E+08 | 37% | 663% | 5 |
| T343R/N346D | T175R/N178D | 1.6E+07 | 2.6E+06 | 16% | 36% | 2 |
| R318Y/R338E/T343R/N346D/R403E/E410N | R150Y/R170E/T175R/N178D/R233E/E240N | 8.2E+07 | 3.2E+06 | 4% | 177% | 2 |
| R318Y/R338E/Y345A/R403E/E410N | R150Y/R170E/Y177A/R233E/E240N | 8.3E+07 | 3.6E+07 | 44% | 180% | 6 |
| R318Y/R338E/Y345A/N346D/R403E/E410N | R150Y/R170E/Y177A/N178D/R233E/E240N | 2.3E+07 | 7.6E+06 | 33% | 49% | 3 |
| Y155F/K247N/N249S/R318Y/R338E/R403E | Y[155]F/K82N/N84S/R150Y/R170E/R233E | 9.5E+07 | 6.6E+07 | 69% | 206% | 5 |
| K247N/N249S/R318Y/R338E/R403E | K82N/N84S/R150Y/R170E/R233E | 2.3E+08 | 1.6E+08 | 71% | 496% | 2 |
| Y155F/K247N/N249S/R318Y/R403E/E410N | Y[155]F/K82N/N84S/R150Y/R233E/E240N | 1.0E+07 | 4.5E+06 | 45% | 22% | 3 |
| K247N/N249S/R318Y/R403E/E410N | K82N/N84S/R150Y/R233E/E240N | 2.7E+07 | 1.2E+07 | 44% | 58% | 10 |
| Y155F/K247N/N249S/R338E/R403E/E410N | Y[155]F/K82N/N84S/R170E/R233E/E240N | 1.1E+08 | 2.4E+07 | 23% | 229% | 3 |
| K247N/N249S/R338E/R403E/E410N | K82N/N84S/R170E/R233E/E240N | 1.9E+08 | 2.9E+07 | 15% | 422% | 2 |
| R318Y/R338E/T343R/R403E | R150Y/R170E/T175R/R233E | 1.6E+08 | 7.4E+07 | 45% | 357% | 4 |
| Y155F/R318Y/R338E/T343R/R403E | Y[155]F/R150Y/R170E/T175R/R233E | 2.6E+08 | 1.7E+08 | 65% | 563% | 4 |
| R318Y/R338E/T343R/E410N | R150Y/R170E/T175R/E240N | 3.4E+08 | 1.6E+08 | 48% | 728% | 16 |
| Y155F/R318Y/R338E/T343R/E410N | Y[155]F/R150Y/R170E/T175R/E240N | 3.7E+08 | 1.2E+08 | 32% | 794% | 4 |
| R318Y/T343R/R403E/E410N | R150Y/T175R/R233E/E240N | 5.8E+07 | 1.8E+07 | 31% | 125% | 3 |
| Y155F/R318Y/T343R/R403E/E410N | Y[155]F/R150Y/T175R/R233E/E240N | 2.6E+08 | 5.0E+07 | 19% | 571% | 2 |
| R338E/T343R/R403E/E410N | R170E/T175R/R233E/E240N | 3.0E+08 | 8.2E+07 | 27% | 650% | 2 |
| Y155F/R338E/T343R/R403E/E410N | Y[155]F/R170E/T175R/R233E/E240N | 2.4E+08 | 1.0E+08 | 42% | 524% | 4 |
| Y155F/K247N/N249S/R318Y/R338E/T343R/R403E/E410N | Y[155]F/K82N/N84S/R150Y/R170E/T175R/R233E/E240N | 4.0E+08 | 1.5E+08 | 37% | 864% | 11 |
| K247N/N249S/R318Y/R338E/T343R/R403E/E410N | K82N/N84S/R150Y/R170E/T175R/R233E/E240N | 3.8E+08 | 1.5E+08 | 40% | 824% | 5 |
| K228N/I251S/R318Y/R338E/R403E/E410N | K63N/I86S/R150Y/R170E/R233E/E240N | 2.1E+08 | 7.2E+07 | 34% | 463% | 7 |
| Y155F/K228N/I251S/R318Y/R338E/R403E/E410N | Y[155]F/K63N/I86S/R150Y/R170E/R233E/E240N | 1.4E+08 | 5.0E+07 | 37% | 296% | 5 |
| N260S/R318Y/R338E/T343R/R403E/E410N | N95S/R150Y/R170E/T175R/R233E/E240N | 2.9E+08 | 1.1E+08 | 38% | 638% | 7 |
| Y155F/N260S/R318Y/R338E/T343R/R403E/E410N | Y[155]F/N95S/R150Y/R170E/T175R/R233E/E240N | 1.5E+08 | 6.0E+07 | 39% | 335% | 5 |

TABLE 15-continued

Catalytic activity of FIXa variants ($k_{cat}/K_M$)

| Mutation (Mature FIX Numbering) | Mutation (Chymotrypsin Numbering) | $k_{cat}/K_M$ ($M^{-1}s^{-1}$) | ±S.D. ($M^{-1}s^{-1}$) | % CV | % of WT $k_{cat}/K_M$ | n |
|---|---|---|---|---|---|---|
| K228N/K247N/N249S/R318Y/R338E/T343R/R403E/E410N | K63N/K82N/N84S/R150Y/R170E/T175R/R233E/E240N | 4.1E+08 | 1.4E+08 | 34% | 880% | 12 |
| Y155F/K228N/K247N/N249S/R318Y/R338E/T343R/R403E/E410N | Y[155]F/K63N/K82N/N84S/R150Y/R170E/T175R/R233E/E240N | 3.0E+08 | 1.1E+08 | 37% | 646% | 5 |
| Y155F/R338E/T343R/R403E | Y[155]F/R170E/T175R/R233E | 2.0E+08 | 7.7E+07 | 39% | 429% | 5 |
| R338E/T343R/R403E | R170E/T175R/R233E | 3.1E+08 | 9.6E+07 | 31% | 663% | 2 |
| Y155F/R338E/T343R/R403E/E410S | Y[155]F/R170E/T175R/R233E/E240S | 2.9E+08 | 1.0E+08 | 35% | 629% | 6 |
| Y155F/N260S/R338E/T343R/R403E | Y[155]F/N95S/R170E/T175R/R233E | 9.4E+07 | 3.1E+07 | 33% | 203% | 6 |
| Y155F/I251S/R338E/T343R/R403E | Y[155]F/I86S/R170E/T175R/R233E | 3.0E+08 | 1.6E+07 | 5% | 651% | 2 |
| R318Y/R338E/T343R/R403E/E410S | R150Y/R170E/T175R/R233E/E240S | 4.4E+08 | 1.7E+08 | 39% | 962% | 14 |
| Y155F/K247N/N249S/T343R/R403E | Y[155]F/K82N/N84S/T175R/R233E | 8.5E+07 | 2.7E+07 | 31% | 184% | 4 |
| Y155F/K247N/N249S/R318Y/R338E/T343R/R403E | Y[155]F/K82N/N84S/R150Y/R170E/T175R/R233E | 2.9E+08 | 5.0E+06 | 2% | 630% | 2 |
| K247N/N249S/R318Y/R338E/T343R/R403E | K82N/N84S/R150Y/R170E/T175R/R233E | 4.1E+08 | 2.2E+08 | 55% | 886% | 4 |
| Y155F/K247N/N249S/R338E/T343R/R403E/E410N | Y[155]F/K82N/N84S/R170E/T175R/R233E/E240N | 3.7E+08 | 1.1E+07 | 3% | 805% | 2 |
| K247N/N249S/R338E/T343R/R403E/E410N | K82N/N84S/R170E/T175R/R233E/E240N | 4.3E+08 | 1.2E+07 | 3% | 930% | 2 |
| Y155F/K247N/N249S/R318Y/R338E | Y[155]F/K82N/N84S/R150Y/R170E | 2.9E+08 | 4.1E+07 | 14% | 632% | 2 |
| Y155F/K247N/N249S/R318Y/T343R | Y[155]F/K82N/N84S/R150Y/T175R | 2.5E+08 | 9.4E+07 | 37% | 549% | 4 |
| Y155F/K247N/N249S/R318Y/R403E | Y[155]F/K82N/N84S/R150Y/R233E | 1.6E+07 | 5.4E+06 | 35% | 34% | 3 |
| Y155F/K247N/N249S/R318Y/E410N | Y[155]F/K82N/N84S/R150Y/E240N | 7.2E+07 | 2.5E+07 | 35% | 155% | 3 |
| Y155F/K247N/N249S/R338E/R403E | Y[155]F/K82N/N84S/R170E/R233E | 1.4E+08 | 5.7E+07 | 41% | 299% | 2 |
| Y155F/K247N/N249S/R338E/T343R | Y[155]F/K82N/N84S/R170E/T175R | 7.3E+08 | 2.6E+08 | 36% | 1579% | 2 |
| Y155F/K247N/N249S/R318Y/R338E/T343R/E410N | Y[155]F/K82N/N84S/R150Y/R170E/T175R/E240N | 5.0E+08 | 2.8E+08 | 57% | 1091% | 4 |
| K247N/N249S/R318Y/R338E/T343R/E410N | K82N/N84S/R150Y/R170E/T175R/E240N | 3.2E+08 | 1.6E+08 | 50% | 687% | 6 |
| Y155F/K247N/N249S/R318Y/T343R/R403E/E410N | Y[155]F/K82N/N84S/R150Y/T175R/R233E/E240N | 1.6E+08 | 6.2E+07 | 38% | 350% | 2 |
| K247N/N249S/R318Y/T343R/R403E/E410N | K82N/N84S/R150Y/T175R/R233E/E240N | 1.3E+08 | 3.9E+07 | 30% | 279% | 7 |
| Y155F/K247N/N249S/R338E/E410N | Y[155]F/K82N/N84S/R170E/E240N | 4.7E+08 | 3.1E+08 | 66% | 1009% | 8 |
| Y155F/K247N/N249S/R318Y/T343R/R403E | Y[155]F/K82N/N84S/R150Y/T175R/R233E | 1.3E+08 | 5.1E+07 | 40% | 276% | 2 |
| K247N/N249S/R318Y/T343R/R403E | K82N/N84S/R150Y/T175R/R233E | 3.9E+07 | 2.2E+07 | 57% | 84% | 9 |
| Y155F/K247N/N249S/R318Y/T343R/E410N | Y[155]F/K82N/N84S/R150Y/T175R/E240N | 3.1E+08 | 2.1E+08 | 67% | 668% | 4 |
| K247N/N249S/R318Y/T343R/E410N | K82N/N84S/R150Y/T175R/E240N | 2.0E+08 | 1.6E+08 | 77% | 439% | 4 |
| Y155F/K247N/N249S/R338E/T343R/R403E | Y[155]F/K82N/N84S/R170E/T175R/R233E | 5.9E+08 | 5.8E+07 | 10% | 1269% | 2 |
| K247N/N249S/R338E/T343R/R403E | K82N/N84S/R170E/T175R/R233E | 5.6E+08 | 8.8E+07 | 16% | 1215% | 2 |
| Y155F/K247N/N249S/R338E/T343R/E410N | Y[155]F/K82N/N84S/R170E/T175R/E240N | 1.8E+08 | 1.1E+07 | 6% | 391% | 2 |
| K247N/N249S/R338E/T343R/E410N | K82N/N84S/R170E/T175R/E240N | 3.1E+08 | 1.0E+08 | 33% | 676% | 5 |
| Y155F/K247N/N249S/T343R/R403E/E410N | Y[155]F/K82N/N84S/T175R/R233E/E240N | 2.9E+08 | 8.8E+07 | 30% | 635% | 2 |
| K247N/N249S/T343R/R403E/E410N | K82N/N84S/T175R/R233E/E240N | 1.3E+08 | 1.7E+07 | 13% | 285% | 2 |
| Y155F/R318Y/R338E/T343R | Y[155]F/R150Y/R170E/T175R | 3.6E+08 | 1.5E+08 | 41% | 771% | 7 |
| R318Y/R338E/T343R | R150Y/R170E/T175R | 1.5E+08 | 3.3E+07 | 22% | 324% | 2 |
| Y155F/R318Y/T343R/R403E | Y[155]F/R150Y/T175R/R233E | 7.1E+07 | 1.4E+07 | 20% | 154% | 2 |

TABLE 15-continued

Catalytic activity of FIXa variants ($k_{cat}/K_M$)

| Mutation (Mature FIX Numbering) | Mutation (Chymotrypsin Numbering) | $k_{cat}/K_M$ ($M^{-1}s^{-1}$) | ±S.D. ($M^{-1}s^{-1}$) | % CV | % of WT $k_{cat}/K_M$ | n |
|---|---|---|---|---|---|---|
| Y155F/T343R/R403E/E410N | Y[155]F/T175R/R233E/E240N | 1.5E+08 | 2.4E+07 | 17% | 321% | 2 |
| Y155F/K247N/N249S/R318Y/R338E/T343R | Y[155]F/K82N/N84S/R150Y/R170E/T175R | 3.6E+08 | 1.6E+08 | 45% | 772% | 7 |
| K247N/N249S/R318Y/R338E/T343R | K82N/N84S/R150Y/R170E/T175R | 3.9E+08 | 1.6E+08 | 43% | 840% | 4 |
| Y155F/K247N/N249S/T343R/E410N | Y[155]F/K82N/N84S/T175R/E240N | 2.8E+08 | 1.1E+08 | 38% | 599% | 5 |
| Y155F/K247N/N249S/R403E/E410N | Y[155]F/K82N/N84S/R233E/E240N | 2.4E+07 | 1.4E+07 | 59% | 53% | 7 |
| Y155F/R338E/T343R/E410N | Y[155]F/R170E/T175R/E240N | 3.5E+08 | 2.2E+08 | 62% | 761% | 6 |
| R338E/T343R/E410N | R170E/T175R/E240N | 9.3E+07 | 2.8E+07 | 30% | 201% | 2 |
| Y155F/R318Y/T343R/E410N | Y[155]F/R150Y/T175R/E240N | 1.5E+08 | 6.6E+07 | 44% | 326% | 4 |
| R318Y/T343R/E410N | R150Y/T175R/E240N | 6.2E+07 | 1.1E+07 | 17% | 135% | 2 |
| K228N/R318Y/R338E/T343R/R403E/E410N | K63N/R150Y/R170E/T175R/R233E/E240N | 2.7E+08 | 8.8E+07 | 32% | 593% | 3 |
| K228N/K247N/N249S/R318Y/R338E/T343R/R403E | K63N/K82N/N84S/R150Y/R170E/T175R/R233E | 2.9E+08 | 1.3E+08 | 46% | 636% | 3 |
| K228N/247N/N249S/R318Y/R338E/T343R/E410N | K63N/K82N/N84S/R150Y/R170E/T175R/E240N | 1.3E+08 | 4.5E+07 | 35% | 278% | 2 |
| K228N/K247N/N249S/R318Y/T343R/R403E/E410N | K63N/K82N/N84S/R150Y/T175R/R233E/E240N | 7.1E+07 | 3.3E+07 | 46% | 153% | 3 |

†produced in BHK-21 cells;
*80% glycosylated form of E410N

TABLE 16

Catalytic activity of FIXa variants ($k_{cat}$)

| Mutation (Mature FIX Numbering) | Mutation (Chymotrypsin Numbering) | $k_{cat}$ ($s^{-1}$) | ±S.D. ($s^{-1}$) | % CV | n |
|---|---|---|---|---|---|
| BeneFIX Benefix ® Coagulation FIX (T148A) | BeneFIX Benefix ® Coagulation FIX (T[148]A) | 2.8 | 1.1 | 39% | 125 |
| Plasma Purified FIXa | Plasma Purified FIXa | 3.6 | 1.2 | 34% | 120 |
| Catalyst Biosciences WT | Catalyst Biosciences WT | 3.1 | 1.4 | 46% | 31 |
| N157D | N[157]D | 3.3 | 0.5 | 16% | 2 |
| Y155F | Y[155]F | 3.7 | 0.4 | 11% | 2 |
| A103N/N105S/Y155F | A[103]N/N[105]S/Y[155]F | 3.2 | 0.0 | 0% | 2 |
| D104N/K106S/Y155F | D[104]N/K[106]S/Y[155]F | 2.9 | 0.1 | 4% | 2 |
| A103N/N105S | A[103]N/N[105]S | 3.1 | 1.0 | 31% | 9 |
| D104N/K106S | D[104]N/K[106]S | 3.1 | 1.1 | 34% | 9 |
| K106N/V108S | K[106]N/V[108]S | 2.5 | 0.5 | 21% | 7 |
| D85N | D[85]N | 4.2 | 0.8 | 19% | 15 |
| T148A | T[148]A | 2.2 | 0.9 | 42% | 30 |
| T148A† | T[148]A† | 1.6 | 0.2 | 14% | 7 |
| K5A | K[5]A | 3.1 | 0.2 | 8% | 2 |
| D64N | D[64]N | 1.2 | 0.4 | 31% | 2 |
| D64A | D[64]A | 0.3 | 0.2 | 70% | 2 |
| N167D | N[167]D | 2.9 | 0.8 | 27% | 2 |
| N167Q | N[167]Q | 2.3 | 0.7 | 32% | 4 |
| S61A | S[61]A | 3.6 | 1.5 | 41% | 4 |
| S53A | S[53]A | 3.7 | 1.7 | 44% | 3 |
| T159A | T[159]A | 3.7 | 1.2 | 34% | 3 |
| T169A | T[169]A | 4.6 | 1.6 | 36% | 3 |
| T172A | T[172]A | 4.4 | 1.5 | 34% | 3 |
| T179A | T[179]A | 5.1 | 0.6 | 12% | 3 |
| Y155H | Y[155]H | 4.6 | 0.9 | 18% | 3 |
| Y155Q | Y[155]Q | 4.4 | 1.0 | 24% | 3 |
| S158A | S[158]A | 3.9 | 0.1 | 3% | 2 |
| S158D | S[158]D | 3.5 | 0.3 | 8% | 2 |
| S158E | S[158]E | 3.5 | 0.2 | 5% | 2 |
| N157Q | N[157]Q | 3.5 | 0.1 | 4% | 2 |
| D203N/F205T | D39N/F41T | 1.6 | 0.6 | 40% | 12 |
| D85N/D203N/F205T | D[85]N/D39N/F41T | 1.2 | 0.5 | 40% | 5 |
| K228N | K63N | 2.7 | 1.2 | 43% | 13 |
| D85N/K228N | D[85]N/K63N | 2.7 | 0.8 | 29% | 6 |
| A103N/N105S/K228N | A[103]N/N[105]S/K63N | 2.1 | 0.5 | 22% | 3 |
| D104N/K106S/K228N | D[104]N/K[106]S/K63N | 2.4 | 0.1 | 6% | 3 |

TABLE 16-continued

Catalytic activity of FIXa variants ($k_{cat}$)

| Mutation (Mature FIX Numbering) | Mutation (Chymotrypsin Numbering) | $k_{cat}$ ($s^{-1}$) | ±S.D. ($s^{-1}$) | % CV | n |
|---|---|---|---|---|---|
| Y155F/K228N | Y[155]F/K63N | 3.3 | 0.3 | 10% | 2 |
| D104N/K106S/Y155F/K228N | D[104]N/K[106]S/Y[155]F/K63N | 4.6 | 1.2 | 27% | 2 |
| I251S | I86S | 3.8 | 1.1 | 30% | 13 |
| D85N/I251S | D[85]N/I86S | 2.8 | 0.6 | 22% | 5 |
| D85N/D104N/K106S/I251S | D[85]N/D[104]N/K[106]S/I86S | 1.5 | 0.3 | 19% | 5 |
| A103N/N105S/I251S | A[103]N/N[105]S/I86S | 2.9 | 1.0 | 36% | 3 |
| D104N/K106S/I251S | D[104]N/K[106]S/I86S | 2.9 | 0.5 | 18% | 2 |
| Y155F/I251S | Y[155]F/I86S | 3.7 | 0.8 | 22% | 2 |
| A262S | A95bS | 2.3 | 0.7 | 32% | 8 |
| K413N | K243N | 2.6 | 0.5 | 19% | 5 |
| E410N | E240N | 5.0 | 2.2 | 45% | 21 |
| E410N* | E240N* | 2.2 | 0.5 | 25% | 11 |
| E239N | E74N | 1.4 | 0.5 | 36% | 9 |
| T241N/H243S | T76N/H78S | 2.0 | 0.0 | 0% | 2 |
| K247N/N249S | K82N/N84S | 3.9 | 1.0 | 26% | 11 |
| Y155F/K247N/N249S | Y[155]F/K82N/N84S | 3.3 | 0.7 | 21% | 4 |
| A103N/N105S/K247N/N249S | A[103]N/N[105]S/K82N/N84S | 3.4 | 0.5 | 15% | 6 |
| D104N/K106S/K247N/N249S | D[104]N/K[106]S/K82N/N84S | 3.3 | 1.1 | 32% | 2 |
| D104N/K106S/Y155F/K247N/N249S | D[104]N/K[106]S/Y[155]F/K82N/N84S | 2.8 | 1.1 | 40% | 3 |
| L321N | L153N | 1.9 | 0.1 | 4% | 2 |
| F314N/H315S | F145N/H147S | No Activity | n.d. | n.d. | 4 |
| S319N/L321S | S151N/L153S | 1.4 | 0.9 | 61% | 3 |
| N260S | N95S | 1.3 | 0.5 | 42% | 13 |
| D104N/K106S/N260S | D[104]N/K[106]S/N95S | 1.2 | 0.7 | 58% | 2 |
| Y155F/N260S | Y[155]F/N95S | 1.9 | 0.6 | 32% | 2 |
| D104N/K106S/Y155F/N260S | D[104]N/K[106]S/Y[155]F/N95S | 0.4 | 0.1 | 28% | 2 |
| Y284N | Y117N | 2.0 | 0.9 | 45% | 8 |
| G317N | G149N | No Activity | n.d. | n.d. | 5 |
| R318N/A320S | R150N/A152S | No Activity | n.d. | n.d. | 8 |
| R318A | R150A | 2.4 | 0.8 | 32% | 3 |
| R318E | R150E | 0.6 | 0.2 | 35% | 3 |
| R318Y | R150Y | 2.9 | 0.7 | 26% | 3 |
| R312Q | R143Q | 0.3 | 0.1 | 26% | 3 |
| R312A | R143A | 0.3 | 0.0 | 8% | 2 |
| R312Y | R143Y | 0.4 | 0.3 | 73% | 2 |
| R312L | R143L | 0.7 | 0.3 | 41% | 2 |
| V202M | V38M | 2.6 | 1.0 | 37% | 2 |
| V202Y | V38Y | 1.8 | 0.2 | 10% | 2 |
| D203M | D39M | 1.8 | 0.8 | 42% | 5 |
| D203Y | D39Y | 1.7 | 0.5 | 27% | 4 |
| A204M | A40M | 0.6 | 0.5 | 84% | 5 |
| A204Y | A40Y | 1.9 | 0.8 | 42% | 2 |
| K400A/R403A | K230A/R233A | 0.3 | 0.0 | 5% | 2 |
| K400E/R403E | K230E/R233E | No Activity | n.d. | n.d. | 4 |
| R403A | R233A | 0.6 | 0.2 | 24% | 7 |
| R403E | R233E | 0.4 | 0.1 | 25% | 6 |
| K400A | K230A | 1.4 | 0.2 | 14% | 2 |
| K400E | K230E | 0.6 | 0.0 | 4% | 2 |
| K293E | K126E | 0.5 | 0.1 | 15% | 2 |
| K293A | K126A | 1.4 | 0.4 | 28% | 2 |
| R333A | R165A | No Activity | n.d. | n.d. | 2 |
| R333E | R165E | No Activity | n.d. | n.d. | 2 |
| R338A | R170A | 5.4 | 0.3 | 5% | 2 |
| R338E | R170E | 4.7 | 1.0 | 21% | 10 |
| R338A/R403A | R170A/R233A | 3.8 | 0.9 | 24% | 6 |
| R338E/R403E | R170E/R233E | 3.3 | 1.2 | 37% | 2 |
| K293A/R403A | K126A/R233A | 0.4 | 0.0 | 9% | 2 |
| K293E/R403E | K126E/R233E | 0.1 | 0.0 | 37% | 2 |
| K293A/R338A/R403A | K126A/R170A/R233A | 1.6 | 0.7 | 41% | 2 |
| K293E/R338E/R403E | K126E/R170E/R233E | 0.8 | 0.2 | 27% | 2 |
| R318A/R403A | R150A/R233A | 0.7 | 0.1 | 12% | 2 |
| R318E/R403E | R150E/R233E | 0.1 | 0.0 | 35% | 2 |
| R318Y/E410N | R150Y/E240N | 3.5 | 0.9 | 27% | 21 |
| R338E/E410N | R170E/E240N | 5.2 | 0.8 | 16% | 8 |
| R338E/R403E/E410N | R170E/R233E/E240N | 3.3 | 1.3 | 39% | 7 |
| R318Y/R338E/R403E | R150Y/R170E/R233E | 3.5 | 0.4 | 11% | 2 |

TABLE 16-continued

Catalytic activity of FIXa variants ($k_{cat}$)

| Mutation (Mature FIX Numbering) | Mutation (Chymotrypsin Numbering) | $k_{cat}$ ($s^{-1}$) | ±S.D. ($s^{-1}$) | % CV | n |
|---|---|---|---|---|---|
| D203N/F205T/K228N | D39N/F41T/K63N | 0.6 | 0.2 | 27% | 2 |
| D203N/F205T/E410N | D39N/F41T/E240N | 1.7 | 0.3 | 16% | 6 |
| D203N/F205T/R338E | D39N/F41T/R170E | 2.5 | 0.0 | 2% | 2 |
| D203N/F205T/R338A | D39N/F41T/R170A | 2.3 | 0.5 | 23% | 3 |
| D203N/F205T/R318Y | D39N/F41T/R150Y | 0.9 | 0.1 | 13% | 4 |
| D203N/F205T/R338E/R403E | D39N/F41T/R170E/R233E | 0.9 | 0.0 | 5% | 2 |
| K228N/E410N | K63N/E240N | 3.5 | 0.9 | 27% | 10 |
| K228N/R338E | K63N/R170E | 4.8 | 0.8 | 17% | 2 |
| K228N/R338A | K63N/R170A | 6.5 | 0.5 | 7% | 2 |
| K228N/R318Y | K63N/R150Y | 2.9 | 0.6 | 19% | 5 |
| K228N/R338E/R403E | K63N/R170E/R233E | 2.8 | 0.3 | 9% | 2 |
| R403E/E410N | R233E/E240N | 2.0 | 0.2 | 9% | 2 |
| R318Y/R338E/E410N | R150Y/R170E/E240N | 4.6 | 1.3 | 29% | 26 |
| D104N/K106S/R318Y/R338E/E410N | D[104]N/K[106]S/R150Y/R170E/E240N | 4.8 | 0.6 | 12% | 4 |
| Y155F/R318Y/R338E/E410N | Y[155]F/R150Y/R170E/E240N | 5.6 | 1.4 | 25% | 5 |
| K228N/R318Y/E410N | K63N/R150Y/E240N | 5.0 | 0.5 | 10% | 4 |
| R318Y/R403E/E410N | R150Y/R233E/E240N | 2.3 | 0.3 | 15% | 3 |
| R318Y/R338E/R403E/E410N | R150Y/R170E/R233E/E240N | 5.0 | 3.1 | 63% | 14 |
| A103N/N105S/R318Y/R338E/R403E/E410N | A[103]N/N[105]S/R150Y/R170E/R233E/E240N | 5.4 | 0.9 | 16% | 5 |
| D104N/K106S/R318Y/R338E/R403E/E410N | D[104]N/K[106]S/R150Y/R170E/R233E/E240N | 5.7 | 1.1 | 20% | 3 |
| Y155F/R318Y/R338E/R403E/E410N | Y[155]F/R150Y/R170E/R233E/E240N | 5.3 | 0.7 | 12% | 4 |
| A103N/N105S/Y155F/R318Y/R338E/R403E/E410N | A[103]N/N[105]S/Y[155]F/R150Y/R170E/R233E/E240N | 6.4 | 0.5 | 7% | 2 |
| D104N/K106S/Y155F/R318Y/R338E/R403E/E410N | D[104]N/K[106]S/Y[155]F/R150Y/R170E/R233E/E240N | 8.5 | 0.8 | 10% | 2 |
| D203N/F205T/R318Y/E410N | D39N/F41T/R150Y/E240N | 1.6 | 0.6 | 36% | 6 |
| R333S | R165S | 0.05 | 0.01 | 22% | 3 |
| R338L | R170L | 9.5 | 1.9 | 21% | 3 |
| K316N | K148N | 0.3 | 0.1 | 39% | 3 |
| K316A | K148A | 0.3 | 0.1 | 21% | 3 |
| K316E | K148E | 0.1 | 0.0 | 9% | 3 |
| K316S | K148S | 0.2 | 0.0 | 10% | 3 |
| K316M | K148M | 0.7 | 0.1 | 15% | 3 |
| E239S | E74S | 0.7 | 0.1 | 19% | 3 |
| E239A | E74A | 2.8 | 1.2 | 43% | 3 |
| E239R | E74R | 3.4 | 1.4 | 42% | 3 |
| E239K | E74K | 3.0 | 1.1 | 36% | 3 |
| H257F | H92F | 3.0 | 1.4 | 46% | 3 |
| H257Y | H92Y | 2.0 | 1.1 | 55% | 3 |
| H257E | H92E | 1.3 | 0.4 | 28% | 3 |
| H257S | H92S | 1.8 | 0.3 | 18% | 3 |
| T412A | T242A | 2.6 | 0.3 | 13% | 5 |
| T412V | T242V | 2.6 | 0.6 | 25% | 8 |
| E410N/T412A | E240N/T242A | 2.9 | 0.4 | 13% | 4 |
| E410N/T412V | E240N/T242V | 2.9 | 0.5 | 16% | 4 |
| E410Q | E240Q | 6.0 | 2.8 | 46% | 4 |
| E410S | E240S | 4.9 | 1.6 | 32% | 12 |
| E410A | E240A | 4.8 | 1.6 | 32% | 10 |
| E410D | E240D | 4.0 | 0.7 | 19% | 4 |
| N346D | N178D | 0.8 | 0.2 | 29% | 4 |
| Y155F/N346D | Y[155]F/N178D | 1.3 | 0.5 | 41% | 2 |
| N346Y | N178Y | 2.6 | 0.2 | 9% | 8 |
| Y345A | Y177A | 0.7 | 0.6 | 83% | 4 |
| Y345T | Y177T | 1.3 | 0.3 | 27% | 4 |
| T343R | T175R | 4.3 | 1.2 | 27% | 9 |
| T343E | T175E | 1.0 | 0.7 | 72% | 4 |
| T343Q | T175Q | 2.5 | 0.3 | 11% | 3 |
| F342I | F174I | 1.3 | 0.2 | 16% | 3 |
| T343R/Y345T | T175R/Y177T | 2.4 | 0.3 | 14% | 3 |
| R318Y/R338E | R150Y/R170E | 3.4 | 0.5 | 14% | 4 |
| Y259F/K265T/Y345T | Y94F/K98T/Y177T | 1.7 | 0.1 | 5% | 2 |
| K228N/I251S | K63N/I86S | 2.7 | 1.1 | 41% | 2 |
| K228N/R318Y/R338E/R403E/E410N | K63N/R150Y/R170E/R233E/E240N | 5.1 | 0.7 | 14% | 3 |
| Y155F/K228N/R318Y/R338E/R403E/E410N | Y[155]F/K63N/R150Y/R170E/R233E/E240N | 9.7 | 1.6 | 16% | 2 |
| D85N/K228N/R318Y/R338E/R403E/E410N | D[85]N/K63N/R150Y/R170E/R233E/E240N | 6.0 | 0.6 | 10% | 2 |
| I251S/R318Y/R338E/R403E/E410N | I86S/R150Y/R170E/R233E/E240N | 4.8 | 0.6 | 12% | 4 |

TABLE 16-continued

Catalytic activity of FIXa variants ($k_{cat}$)

| Mutation (Mature FIX Numbering) | Mutation (Chymotrypsin Numbering) | $k_{cat}$ (s$^{-1}$) | ±S.D. (s$^{-1}$) | % CV | n |
|---|---|---|---|---|---|
| D104N/K106S/I251S/R318Y/R338E/R403E/E410N | D[104]N/K[106]S/I86S/R150Y/R170E/R233E/E240N | 5.5 | 0.9 | 17% | 8 |
| Y155F/I251S/R318Y/R338E/R403E/E410N | Y[155]F/I86S/R150Y/R170E/R233E/E240N | 7.2 | 0.8 | 11% | 2 |
| I251S/R318Y/R338E/E410N | I86S/R150Y/R170E/E240N | 6.2 | 1.2 | 20% | 7 |
| D104N/K106S/I251S/R318Y/R338E/E410N | D[104]N/K[106]S/I86S/R150Y/R170E/E240N | 3.1 | 0.6 | 19% | 3 |
| F314N/K316S | F145N/K148S | 0.0 | 0.0 | 7% | 2 |
| K247N/N249S/R318Y/R338E/R403E/E410N | K82N/N84S/R150Y/R170E/R233E/E240N | 5.8 | 1.1 | 19% | 6 |
| Y155F/K247N/N249S/R318Y/R338E/R403E/E410N | Y[155]F/K82N/N84S/R150Y/R170E/R233E/E240N | 6.5 | 1.1 | 17% | 6 |
| A103N/N105S/K247N/N249S/R318Y/R338E/R403E/E410N | A[103]N/N[105]S/K82N/N84S/R150Y/R170E/R233E/E240N | 4.1 | 0.8 | 18% | 2 |
| D104N/K106S/K247N/N249S/R318Y/R338E/R403E/E410N | D[104]N/K[106]S/K82N/N84S/R150Y/R170E/R233E/E240N | 5.2 | 0.3 | 6% | 2 |
| K247N/N249S/R318Y/R338E/E410N | K82N/N84S/R150Y/R170E/E240N | 3.8 | 1.6 | 41% | 6 |
| Y155F/K247N/N249S/R318Y/R338E/E410N | Y[155]F/K82N/N84S/R150Y/R170E/E240N | 4.3 | 1.4 | 33% | 7 |
| R318Y/R338E/R403E/E410S | R150Y/R170E/R233E/E240S | 5.8 | 0.6 | 10% | 4 |
| R318Y/R338E/E410S | R150Y/R170E/E240S | 5.1 | 1.7 | 33% | 8 |
| K228N/K247N/N249S | K63N/K82N/N84S | 3.5 | 0.1 | 4% | 2 |
| D104N/K106S/Y155F/K228N/K247N/N249S | D[104]N/K[106]S/Y[155]F/K63N/K82N/N84S | 4.7 | 1.4 | 30% | 2 |
| D104N/K106S/K228N/K247N/N249S | D[104]N/K[106]S/K63N/K82N/N84S | 1.7 | 0.9 | 54% | 5 |
| Y155F/K228N/K247N/N249S | Y[155]F/K63N/K82N/N84S | 4.3 | 1.9 | 44% | 2 |
| K228N/K247N/N249S/R318Y/R338E/R403E/E410N | K63N/K82N/N84S/R150Y/R170E/R233E/E240N | 6.1 | 0.7 | 12% | 3 |
| R318Y/R338E/R403E/E410N/T412V | R150Y/R170E/R233E/E240N/T242V | 7.9 | 2.1 | 26% | 4 |
| R318Y/R338E/R403E/E410N/T412A | R150Y/R170E/R233E/E240N/T242A | 8.4 | 1.5 | 18% | 4 |
| R318Y/R338E/R403E/T412A | R150Y/R170E/R233E/T242A | 5.1 | 1.1 | 21% | 4 |
| R318Y/R338E/T412A | R150Y/R170E/T242A | 7.0 | 2.8 | 39% | 6 |
| R318Y/R338E/E410N/T412V | R150Y/R170E/E240N/T242V | 6.3 | 2.3 | 37% | 4 |
| N260S/R318Y/R338E/R403E/E410N | N95S/R150Y/R170E/R233E/E240N | 3.8 | 1.1 | 29% | 2 |
| D104N/K106S/N260S/R318Y/R338E/R403E/E410N | D[104]N/K[106]S/N95S/R150Y/R170E/R233E/E240N | 5.4 | 0.5 | 9% | 2 |
| Y155F/N260S/R318Y/R338E/R403E/E410N | Y[155]F/N95S/R150Y/R170E/R233E/E240N | 5.8 | 1.7 | 30% | 2 |
| R318Y/R338E/N346D/R403E/E410N | R150Y/R170E/N178D/R233E/E240N | 2.5 | 1.3 | 54% | 2 |
| Y155F/R318Y/R338E/N346D/R403E/E410N | Y[155]F/R150Y/R170E/N178D/R233E/E240N | 6.4 | 2.8 | 44% | 2 |
| K247N/N249S/N260S | K82N/N84S/N95S | 3.3 | 0.3 | 9% | 2 |
| Y155F/K247N/N249S/N260S | Y[155]F/K82N/N84S/N95S | 1.8 | 0.3 | 16% | 2 |
| D104N/K106S/K247N/N249S/N260S | D[104]N/K[106]S/K82N/N84S/N95S | 0.6 | 0.0 | 7% | 2 |
| D104N/K106S/Y155F/K247N/N249S/N260S | D[104]N/K[106]S/Y[155]F/K82N/N84S/N95S | 0.5 | 0.0 | 2% | 2 |
| K247N/N249S/N260S/R318Y/R338E/R403E/E410N | K82N/N84S/N95S/R150Y/R170E/R233E/E240N | 6.0 | 0.5 | 9% | 2 |
| Y155F/N260S/N346D | Y[155]F/N95S/N178D | 0.3 | 0.1 | 29% | 2 |
| R318Y/R338E/T343R/R403E/E410N | R150Y/R170E/T175R/R233E/E240N | 11.8 | 2.4 | 20% | 3 |
| R338E/T343R | R170E/T175R | 7.7 | 1.3 | 17% | 4 |

†produced in BHK-21 cells;
*80% glycosylated form of E410N

TABLE 17

Catalytic activity of FIXa variants ($k_{cat}$)

| Mutation (Mature FIX Numbering) | Mutation (Chymotrypsin Numbering) | $k_{cat}$ (s$^{-1}$) | ±S.D. (s$^{-1}$) | % CV | n |
|---|---|---|---|---|---|
| BeneFIX Benefix ® Coagulation FIX (T148A) | BeneFIX Benefix ® Coagulation FIX (T[148]A) | 2.9 | 1.1 | 39% | 140 |
| Plasma Purified FIXa | Plasma Purified FIXa | 3.7 | 1.3 | 36% | 200 |

TABLE 17-continued

Catalytic activity of FIXa variants ($k_{cat}$)

| Mutation (Mature FIX Numbering) | Mutation (Chymotrypsin Numbering) | $k_{cat}$ ($s^{-1}$) | ±S.D. ($s^{-1}$) | % CV | n |
|---|---|---|---|---|---|
| Catalyst Biosciences WT | Catalyst Biosciences WT | 3.1 | 1.4 | 46% | 33 |
| N157D | N[157]D | 3.3 | 0.5 | 16% | 2 |
| Y155F | Y[155]F | 3.7 | 0.4 | 11% | 2 |
| A103N/N105S/Y155F | A[103]N/N[105]S/Y[155]F | 3.2 | 0.0 | 0% | 2 |
| D104N/K106S/Y155F | D[104]N/K[106]S/Y[155]F | 2.9 | 0.1 | 4% | 2 |
| A103N/N105S | A[103]N/N[105]S | 3.1 | 1.0 | 31% | 9 |
| D104N/K106S | D[104]N/K[106]S | 3.1 | 1.1 | 34% | 9 |
| K106N/V108S | K[106]N/V[108]S | 2.5 | 0.5 | 21% | 7 |
| D85N | D[85]N | 4.1 | 0.8 | 20% | 17 |
| T148A | T[148]A | 2.5 | 1.0 | 39% | 44 |
| T148A† | T[148]A† | 1.6 | 0.2 | 14% | 7 |
| K5A | K[5]A | 3.5 | 0.8 | 23% | 4 |
| D64N | D[64]N | 1.2 | 0.4 | 31% | 2 |
| D64A | D[64]A | 0.3 | 0.2 | 70% | 2 |
| N167D | N[167]D | 2.9 | 0.8 | 27% | 2 |
| N167Q | N[167]Q | 2.3 | 0.7 | 32% | 4 |
| S61A | S[61]A | 3.6 | 1.5 | 41% | 4 |
| S53A | S[53]A | 3.7 | 1.7 | 44% | 3 |
| T159A | T[159]A | 3.7 | 1.2 | 34% | 3 |
| T169A | T[169]A | 4.6 | 1.6 | 36% | 3 |
| T172A | T[172]A | 4.4 | 1.5 | 34% | 3 |
| T179A | T[179]A | 5.1 | 0.6 | 12% | 3 |
| Y155H | Y[155]H | 4.6 | 0.9 | 18% | 3 |
| Y155Q | Y[155]Q | 4.4 | 1.0 | 24% | 3 |
| S158A | S[158]A | 3.9 | 0.1 | 3% | 2 |
| S158D | S[158]D | 3.5 | 0.3 | 8% | 2 |
| S158E | S[158]E | 3.5 | 0.2 | 5% | 2 |
| N157Q | N[157]Q | 3.5 | 0.1 | 4% | 2 |
| D203N/F205T | D39N/F41T | 1.6 | 0.6 | 40% | 12 |
| D85N/D203N/F205T | D[85]N/D39N/F41T | 1.2 | 0.5 | 40% | 5 |
| K228N | K63N | 2.7 | 1.2 | 43% | 13 |
| D85N/K228N | D[85]N/K63N | 2.7 | 0.8 | 29% | 6 |
| A103N/N105S/K228N | A[103]N/N[105]S/K63N | 2.1 | 0.5 | 22% | 3 |
| D104N/K106S/K228N | D[104]N/K[106]S/K63N | 2.4 | 0.1 | 6% | 3 |
| Y155F/K228N | Y[155]F/K63N | 3.3 | 0.3 | 10% | 2 |
| D104N/K106S/Y155F/K228N | D[104]N/K[106]S/Y[155]F/K63N | 4.6 | 1.2 | 27% | 2 |
| I251S | I86S | 3.8 | 1.1 | 30% | 13 |
| D85N/I251S | D[85]N/I86S | 2.8 | 0.6 | 22% | 5 |
| D85N/D104N/K106S/I251S | D[85]N/D[104]N/K[106]S/I86S | 1.5 | 0.3 | 19% | 5 |
| A103N/N105S/I251S | A[103]N/N[105]S/I86S | 2.9 | 1.0 | 36% | 3 |
| D104N/K106S/I251S | D[104]N/K[106]S/I86S | 2.9 | 0.5 | 18% | 2 |
| Y155F/I251S | Y[155]F/I86S | 3.7 | 0.8 | 22% | 2 |
| A262S | A95bS | 2.3 | 0.7 | 32% | 8 |
| K413N | K243N | 2.5 | 0.5 | 19% | 7 |
| E410N | E240N | 4.9 | 2.0 | 41% | 27 |
| E410N* | E240N* | 2.3 | 0.5 | 22% | 10 |
| E239N | E74N | 1.4 | 0.5 | 36% | 9 |
| T241N/H243S | T76N/H78S | 2.0 | 0.0 | 0% | 2 |
| K247N/N249S | K82N/N84S | 3.9 | 1.0 | 26% | 11 |
| Y155F/K247N/N249S | Y[155]F/K82N/N84S | 3.3 | 0.7 | 21% | 4 |
| A103N/N105S/K247N/N249S | A[103]N/N[105]S/K82N/N84S | 3.4 | 0.5 | 15% | 6 |
| D104N/K106S/K247N/N249S | D[104]N/K[106]S/K82N/N84S | 3.3 | 1.1 | 32% | 2 |
| D104N/K106S/Y155F/K247N/N249S | D[104]N/K[106]S/Y[155]F/K82N/N84S | 2.8 | 1.1 | 40% | 3 |
| L321N | L153N | 1.9 | 0.1 | 4% | 2 |
| F314N/H315S | F145N/H147S | 0.0 | 0.0 | 7% | 2 |
| K392N/K394S | K222N/K224S | 0.0 | n.d. | n.d. | 0 |
| S319N/L321S | S151N/L153S | 1.4 | 0.9 | 61% | 3 |
| N260S | N95S | 1.3 | 0.5 | 42% | 13 |
| D104N/K106S/N260S | D[104]N/K[106]S/N95S | 1.2 | 0.7 | 58% | 2 |
| Y155F/N260S | Y[155]F/N95S | 1.9 | 0.6 | 32% | 2 |
| D104N/K106S/Y155F/N260S | D[104]N/K[106]S/Y[155]F/N95S | 0.4 | 0.1 | 28% | 2 |
| Y284N | Y117N | 2.0 | 0.9 | 45% | 8 |
| G317N | G149N | 0.0 | n.d. | n.d. | 1 |
| R318N/A320S | R150N/A152S | 0.0 | 0.0 | 95% | 3 |
| R318A | R150A | 2.7 | 0.9 | 32% | 2 |
| R318E | R150E | 0.6 | 0.2 | 35% | 3 |
| R318Y | R150Y | 2.9 | 0.7 | 26% | 3 |
| R312Q | R143Q | 0.3 | 0.1 | 26% | 3 |
| R312A | R143A | 0.3 | 0.0 | 8% | 2 |
| R312Y | R143Y | 0.4 | 0.3 | 73% | 2 |
| R312L | R143L | 0.7 | 0.3 | 41% | 2 |
| V202M | V38M | 2.6 | 1.0 | 37% | 2 |
| V202Y | V38Y | 1.8 | 0.2 | 10% | 2 |
| D203M | D39M | 1.8 | 0.8 | 42% | 5 |
| D203Y | D39Y | 1.7 | 0.5 | 27% | 4 |

TABLE 17-continued

Catalytic activity of FIXa variants ($k_{cat}$)

| Mutation (Mature FIX Numbering) | Mutation (Chymotrypsin Numbering) | $k_{cat}$ ($s^{-1}$) | ±S.D. ($s^{-1}$) | % CV | n |
|---|---|---|---|---|---|
| A204M | A40M | 0.6 | 0.5 | 84% | 5 |
| A204Y | A40Y | 1.9 | 0.8 | 42% | 2 |
| K400A/R403A | K230A/R233A | 0.3 | 0.0 | 5% | 2 |
| K400E/R403E | K230E/R233E | 0.1 | 0.0 | 50% | 3 |
| R403A | R233A | 0.6 | 0.2 | 24% | 7 |
| R403E | R233E | 0.4 | 0.1 | 25% | 6 |
| K400A | K230A | 1.4 | 0.2 | 14% | 2 |
| K400E | K230E | 0.6 | 0.0 | 4% | 2 |
| K293E | K126E | 0.5 | 0.1 | 15% | 2 |
| K293A | K126A | 1.4 | 0.4 | 28% | 2 |
| R333A | R165A | 0.1 | 0.0 | 35% | 2 |
| R333E | R165E | 0.0 | n.d. | n.d. | 1 |
| R338A | R170A | 5.4 | 0.3 | 5% | 2 |
| R338E | R170E | 4.7 | 1.0 | 21% | 10 |
| R338A/R403A | R170A/R233A | 3.8 | 0.9 | 24% | 6 |
| R338E/R403E | R170E/R233E | 3.3 | 1.2 | 37% | 2 |
| K293A/R403A | K126A/R233A | 0.4 | 0.0 | 9% | 2 |
| K293E/R403E | K126E/R233E | 0.1 | 0.0 | 37% | 2 |
| K293A/R338A/R403A | K126A/R170A/R233A | 1.6 | 0.7 | 41% | 2 |
| K293E/R338E/R403E | K126E/R170E/R233E | 0.8 | 0.2 | 27% | 2 |
| R318A/R403A | R150A/R233A | 0.7 | 0.1 | 12% | 2 |
| R318E/R403E | R150E/R233E | 0.1 | 0.0 | 35% | 2 |
| R318Y/E410N | R150Y/E240N | 3.5 | 0.9 | 27% | 21 |
| R338E/E410N | R170E/E240N | 5.2 | 1.1 | 22% | 12 |
| R338E/R403E/E410N | R170E/R233E/E240N | 5.8 | 3.0 | 52% | 17 |
| Y155F/R338E/R403E/E410N | Y[155]F/R170E/R233E/E240N | 5.9 | 0.4 | 7% | 2 |
| R318Y/R338E/R403E | R150Y/R170E/R233E | 3.6 | 0.4 | 10% | 3 |
| Y155F/R318Y/R338E/R403E | Y[155]F/R150Y/R170E/R233E | 5.1 | 1.0 | 19% | 2 |
| D203N/F205T/K228N | D39N/F41T/K63N | 0.6 | 0.2 | 27% | 2 |
| D203N/F205T/E410N | D39N/F41T/E240N | 1.7 | 0.3 | 16% | 6 |
| D203N/F205T/R338E | D39N/F41T/R170E | 2.5 | 0.0 | 2% | 2 |
| D203N/F205T/R338A | D39N/F41T/R170A | 2.3 | 0.5 | 23% | 3 |
| D203N/F205T/R318Y | D39N/F41T/R150Y | 0.9 | 0.1 | 13% | 4 |
| D203N/F205T/R338E/R403E | D39N/F41T/R170E/R233E | 0.9 | 0.0 | 5% | 2 |
| K228N/E410N | K63N/E240N | 3.5 | 0.9 | 27% | 10 |
| K228N/R338E | K63N/R170E | 4.8 | 0.8 | 17% | 2 |
| K228N/R338A | K63N/R170A | 6.5 | 0.5 | 7% | 2 |
| K228N/R318Y | K63N/R150Y | 2.9 | 0.6 | 19% | 5 |
| K228N/R338E/R403E | K63N/R170E/R233E | 2.8 | 0.3 | 9% | 2 |
| R403E/E410N | R233E/E240N | 2.0 | 0.2 | 9% | 2 |
| R318Y/R338E/E410N | R150Y/R170E/E240N | 4.4 | 1.2 | 27% | 42 |
| D104N/K106S/R318Y/R338E/E410N | D[104]N/K[106]S/R150Y/R170E/E240N | 4.8 | 0.6 | 12% | 4 |
| Y155F/R318Y/R338E/E410N | Y[155]F/R150Y/R170E/E240N | 5.6 | 1.4 | 25% | 5 |
| K228N/R318Y/E410N | K63N/R150Y/E240N | 5.0 | 0.5 | 10% | 4 |
| R318Y/R403E/E410N | R150Y/R233E/E240N | 2.3 | 0.3 | 11% | 5 |
| Y155F/R318Y/R403E/E410N | Y[155]F/R150Y/R233E/E240N | 2.9 | 0.6 | 20% | 2 |
| R318Y/R338E/R403E/E410N | R150Y/R170E/R233E/E240N | 5.8 | 2.8 | 48% | 26 |
| A103N/N105S/R318Y/R338E/R403E/E410N | A[103]N/N[105]S/R150Y/R170E/R233E/E240N | 5.4 | 0.9 | 16% | 5 |
| D104N/K106S/R318Y/R338E/R403E/E410N | D[104]N/K[106]S/R150Y/R170E/R233E/E240N | 5.7 | 1.1 | 20% | 3 |
| Y155F/R318Y/R338E/R403E/E410N | Y[155]F/R150Y/R170E/R233E/E240N | 5.3 | 0.7 | 12% | 4 |
| A103N/N105S/Y155F/R318Y/R338E/R403E/E410N | A[103]N/N[105]S/Y[155]F/R150Y/R170E/R233E/E240N | 6.4 | 0.5 | 7% | 2 |
| D104N/K106S/Y155F/R318Y/R338E/R403E/E410N | D[104]N/K[106]S/Y[155]F/R150Y/R170E/R233E/E240N | 8.5 | 0.8 | 10% | 2 |
| D203N/F205T/R318Y/E410N | D39N/F41T/R150Y/E240N | 1.6 | 0.6 | 36% | 6 |
| R333S | R165S | 0.1 | 0.0 | 22% | 3 |
| R338L | R170L | 9.5 | 1.9 | 21% | 3 |
| K316N | K148N | 0.3 | 0.1 | 39% | 3 |
| K316A | K148A | 0.3 | 0.1 | 21% | 3 |
| K316E | K148E | 0.1 | 0.0 | 9% | 3 |
| K316S | K148S | 0.2 | 0.0 | 10% | 3 |
| K316M | K148M | 0.7 | 0.1 | 15% | 3 |
| E239S | E74S | 0.7 | 0.1 | 19% | 3 |
| E239A | E74A | 2.8 | 1.2 | 43% | 3 |
| E239R | E74R | 3.4 | 1.4 | 42% | 3 |
| E239K | E74K | 3.0 | 1.1 | 36% | 3 |
| H257F | H92F | 3.0 | 1.4 | 46% | 3 |
| H257Y | H92Y | 2.0 | 1.1 | 55% | 3 |
| H257E | H92E | 1.3 | 0.4 | 28% | 3 |
| H257S | H92S | 1.8 | 0.3 | 18% | 3 |
| T412A | T242A | 2.6 | 0.3 | 13% | 5 |
| T412V | T242V | 2.6 | 0.6 | 25% | 8 |
| E410N/T412A | E240N/T242A | 2.9 | 0.4 | 13% | 4 |

TABLE 17-continued

Catalytic activity of FIXa variants ($k_{cat}$)

| Mutation (Mature FIX Numbering) | Mutation (Chymotrypsin Numbering) | $k_{cat}$ ($s^{-1}$) | ±S.D. ($s^{-1}$) | % CV | n |
|---|---|---|---|---|---|
| E410N/T412V | E240N/T242V | 2.9 | 0.5 | 16% | 4 |
| E410Q | E240Q | 6.0 | 2.8 | 46% | 4 |
| E410S | E240S | 4.9 | 1.6 | 32% | 12 |
| E410A | E240A | 4.8 | 1.6 | 32% | 10 |
| E410D | E240D | 4.0 | 0.7 | 19% | 4 |
| N346D | N178D | 0.8 | 0.2 | 29% | 4 |
| Y155F/N346D | Y[155]F/N178D | 1.3 | 0.5 | 41% | 2 |
| N346Y | N178Y | 2.6 | 0.2 | 9% | 8 |
| Y345A | Y177A | 0.7 | 0.6 | 83% | 4 |
| Y345T | Y177T | 1.3 | 0.3 | 27% | 4 |
| T343R | T175R | 4.1 | 1.1 | 27% | 12 |
| T343E | T175E | 1.0 | 0.7 | 72% | 4 |
| T343Q | T175Q | 2.5 | 0.3 | 11% | 3 |
| F342I | F174I | 1.3 | 0.2 | 16% | 3 |
| T343R/Y345T | T175R/Y177T | 2.4 | 0.3 | 14% | 3 |
| R318Y/R338E | R150Y/R170E | 3.4 | 0.5 | 14% | 4 |
| Y259F/K265T/Y345T | Y94F/K98T/Y177T | 1.7 | 0.1 | 5% | 2 |
| K228N/I251S | K63N/I86S | 2.7 | 1.1 | 41% | 2 |
| K228N/R318Y/R338E/R403E/E410N | K63N/R150Y/R170E/R233E/E240N | 5.1 | 0.7 | 14% | 3 |
| Y155F/K228N/R318Y/R338E/R403E/E410N | Y[155]F/K63N/R150Y/R170E/R233E/E240N | 6.7 | 3.0 | 45% | 5 |
| D85N/K228N/R318Y/R338E/R403E/E410N | D[85]N/K63N/R150Y/R170E/R233E/E240N | 6.0 | 0.6 | 10% | 2 |
| I251S/R318Y/R338E/R403E/E410N | I86S/R150Y/R170E/R233E/E240N | 4.8 | 0.6 | 12% | 4 |
| D104N/K106S/I251S/R318Y/R338E/R403E/E410N | D[104]N/K[106]S/I86S/R150Y/R170E/R233E/E240N | 5.5 | 0.9 | 17% | 8 |
| Y155F/I251S/R318Y/R338E/R403E/E410N | D[104]N/K[106]S/I86S/R150Y/R170E/R233E/E240N | 7.2 | 0.8 | 11% | 2 |
| I251S/R318Y/R338E/E410N | I86S/R150Y/R170E/E240N | 6.4 | 2.0 | 31% | 10 |
| D104N/K106S/I251S/R318Y/R338E/E410N | D[104]N/K[106]S/I86S/R150Y/R170E/E240N | 3.1 | 0.6 | 19% | 3 |
| F314N/K316S | F145N/K148S | 0.0 | 0.0 | 7% | 2 |
| K247N/N249S/R318Y/R338E/R403E/E410N | K82N/N84S/R150Y/R170E/R233E/E240N | 5.8 | 1.1 | 19% | 6 |
| Y155F/K247N/N249S/R318Y/R338E/R403E/E410N | Y[155]F/K82N/N84S/R150Y/R170E/R233E/E240N | 6.2 | 1.0 | 16% | 10 |
| A103N/N105S/K247N/N249S/R318Y/R338E/R403E/E410N | A[103]N/N[105]S/K82N/N84S/R150Y/R170E/R233E/E240N | 3.9 | 0.4 | 11% | 6 |
| D104N/K106S/K247N/N249S/R318Y/R338E/R403E/E410N | D[104]N/K[106]S/K82N/N84S/R150Y/R170E/R233E/E240N | 5.2 | 0.3 | 6% | 2 |
| D104N/K106S/Y155F/K247N/N249S/R318Y/R338E/R403E/E410N | D[104]N/K[106]S/Y[155]F/K82N/N84S/R150Y/R170E/R233E/E240N | 6.9 | 4.7 | 67% | 6 |
| K247N/N249S/R318Y/R338E/E410N | K82N/N84S/R150Y/R170E/E240N | 3.8 | 1.6 | 41% | 6 |
| Y155F/K247N/N249S/R318Y/R338E/E410N | Y[155]F/K82N/N84S/R150Y/R170E/E240N | 4.5 | 1.3 | 28% | 9 |
| R318Y/R338E/R403E/E410S | R150Y/R170E/R233E/E240S | 7.4 | 2.3 | 31% | 7 |
| R318Y/R338E/E410S | R150Y/R170E/E240S | 5.1 | 1.7 | 33% | 8 |
| K228N/K247N/N249S | K63N/K82N/N84S | 3.5 | 0.1 | 4% | 2 |
| D104N/K106S/Y155F/K228N/K247N/N249S | D[104]N/K[106]S/Y[155]F/K63N/K82N/N84S | 4.7 | 1.4 | 30% | 2 |
| D104N/K106S/K228N/K247N/N249S | D[104]N/K[106]S/K63N/K82N/N84S | 1.7 | 0.9 | 54% | 5 |
| Y155F/K228N/K247N/N249S | Y[155]F/K63N/K82N/N84S | 4.3 | 1.9 | 44% | 2 |
| K228N/K247N/N249S/R318Y/R338E/R403E/E410N | K63N/K82N/N84S/R150Y/R170E/R233E/E240N | 7.1 | 2.2 | 31% | 17 |
| D104N/K106S/K228N/K247N/N249S/R318Y/R338E/R403E/E410N | D[104]N/K[106]S/K63N/K82N/N84S/R150Y/R170E/R233E/E240N | 6.1 | 3.7 | 61% | 7 |
| Y155F/K228N/K247N/N249S/R318Y/R338E/R403E/E410N | Y[155]F/K63N/K82N/N84S/R150Y/R170E/R233E/E240N | 5.1 | 1.8 | 34% | 5 |
| R318Y/R338E/R403E/E410N/T412V | R150Y/R170E/R233E/E240N/T242V | 7.0 | 2.1 | 30% | 6 |
| R318Y/R338E/R403E/E410N/T412A | R150Y/R170E/R233E/E240N/T242A | 7.8 | 1.6 | 20% | 6 |
| R318Y/R338E/R403E/T412A | R150Y/R170E/R233E/T242A | 5.1 | 1.1 | 21% | 4 |
| R318Y/R338E/T412A | R150Y/R170E/T242A | 7.0 | 2.8 | 39% | 6 |
| R318Y/R338E/E410N/T412V | R150Y/R170E/E240N/T242V | 5.2 | 1.7 | 33% | 11 |
| N260S/R318Y/R338E/R403E/E410N | N95S/R150Y/R170E/R233E/E240N | 3.8 | 1.1 | 29% | 2 |
| D104N/K106S/N260S/R318Y/R338E/R403E/E410N | D[104]N/K[106]S/N95S/R150Y/R170E/R233E/E240N | 5.4 | 0.5 | 9% | 2 |
| Y155F/N260S/R318Y/R338E/R403E/E410N | Y[155]F/N95S/R150Y/R170E/R233E/E240N | 5.8 | 1.7 | 30% | 2 |
| R318Y/R338E/N346D/R403E/E410N | R150Y/R170E/N178D/R233E/E240N | 2.5 | 1.3 | 54% | 2 |
| Y155F/R318Y/R338E/N346D/R403E/E410N | Y[155]F/R150Y/R170E/N178D/R233E/E240N | 6.4 | 2.8 | 44% | 2 |
| K247N/N249S/N260S | K82N/N84S/N95S | 3.3 | 0.3 | 9% | 2 |
| Y155F/K247N/N249S/N260S | Y[155]F/K82N/N84S/N95S | 1.8 | 0.3 | 16% | 2 |
| D104N/K106S/K247N/N249S/N260S | D[104]N/K[106]S/K82N/N84S/N95S | 0.6 | 0.0 | 7% | 2 |

TABLE 17-continued

Catalytic activity of FIXa variants ($k_{cat}$)

| Mutation (Mature FIX Numbering) | Mutation (Chymotrypsin Numbering) | $k_{cat}$ ($s^{-1}$) | ±S.D. ($s^{-1}$) | % CV | n |
|---|---|---|---|---|---|
| D104N/K106S/Y155F/K247N/N249S/N260S | D[104]N/K[106]S/Y[155]F/K82N/N84S/N95S | 0.5 | 0.0 | 2% | 2 |
| K247N/N249S/N260S/R318Y/R338E/R403E/E410N | K82N/N84S/N95S/R150Y/R170E/R233E/E240N | 3.4 | 2.1 | 62% | 6 |
| Y155F/K247N/N249S/N260S/R318Y/R338E/R403E/E410N | Y[155]F/K82N/N84S/N95S/R150Y/R170E/R233E/E240N | 3.6 | 1.2 | 33% | 5 |
| Y155F/N260S/N346D | Y[155]F/N95S/N178D | 0.3 | 0.1 | 29% | 2 |
| R318Y/R338E/T343R/R403E/E410N | R150Y/R170E/T175R/R233E/E240N | 9.7 | 2.6 | 27% | 13 |
| Y155F/R318Y/R338E/T343R/R403E/E410N | Y[155]F/R150Y/R170E/T175R/R233E/E240N | 7.8 | 1.9 | 24% | 4 |
| D104N/K106S/R318Y/R338E/T343R/R403E/E410N | D[104]N/K[106]S/R150Y/R170E/T175R/R233E/E240N | 5.7 | 2.3 | 41% | 5 |
| R338E/T343R | R170E/T175R | 7.1 | 1.4 | 20% | 7 |
| T343R/N346Y | T175R/N178Y | 2.3 | 0.5 | 21% | 11 |
| R318Y/R338E/N346Y/R403E/E410N | R150Y/R170E/N178Y/R233E/E240N | 3.4 | 0.3 | 9% | 3 |
| R318Y/R338E/T343R/N346Y/R403E/E410N | R150Y/R170E/T175R/N178Y/R233E/E240N | 4.6 | 1.2 | 26% | 5 |
| T343R/N346D | T175R/N178D | 1.9 | 0.4 | 21% | 2 |
| R318Y/R338E/T343R/N346D/R403E/E410N | R150Y/R170E/T175R/N178D/R233E/E240N | 5.4 | 2.0 | 36% | 2 |
| R318Y/R338E/Y345A/R403E/E410N | R150Y/R170E/Y177A/R233E/E240N | 1.4 | 0.5 | 36% | 6 |
| R318Y/R338E/Y345A/N346D/R403E/E410N | R150Y/R170E/Y177A/N178D/R233E/E240N | 1.2 | 0.3 | 26% | 3 |
| Y155F/K247N/N249S/R318Y/R338E/R403E | Y[155]F/K82N/N84S/R150Y/R170E/R233E | 5.7 | 3.2 | 55% | 5 |
| K247N/N249S/R318Y/R338E/R403E | K82N/N84S/R150Y/R170E/R233E | 10.5 | 3.6 | 34% | 2 |
| Y155F/K247N/N249S/R318Y/R403E/E410N | Y[155]F/K82N/N84S/R150Y/R233E/E240N | 1.2 | 0.5 | 40% | 3 |
| K247N/N249S/R318Y/R403E/E410N | K82N/N84S/R150Y/R233E/E240N | 2.9 | 1.6 | 55% | 10 |
| Y155F/K247N/N249S/R338E/R403E/E410N | Y[155]F/K82N/N84S/R170E/R233E/E240N | 5.0 | 0.6 | 13% | 3 |
| K247N/N249S/R338E/R403E/E410N | K82N/N84S/R170E/R233E/E240N | 4.8 | 0.8 | 17% | 2 |
| R318Y/R338E/T343R/R403E | R150Y/R170E/T175R/R233E | 6.7 | 1.6 | 24% | 4 |
| Y155F/R318Y/R338E/T343R/R403E | Y[155]F/R150Y/R170E/T175R/R233E | 8.2 | 4.1 | 50% | 4 |
| R318Y/R338E/T343R/E410N | R150Y/R170E/T175R/E240N | 4.9 | 1.2 | 24% | 16 |
| Y155F/R318Y/R338E/T343R/E410N | Y[155]F/R150Y/R170E/T175R/E240N | 9.2 | 3.1 | 33% | 4 |
| R318Y/T343R/R403E/E410N | R150Y/T175R/R233E/E240N | 5.3 | 0.9 | 17% | 3 |
| Y155F/R318Y/T343R/R403E/E410N | Y[155]F/R150Y/T175R/R233E/E240N | 8.8 | 0.3 | 4% | 2 |
| R338E/T343R/R403E/E410N | R170E/T175R/R233E/E240N | 9.8 | 1.4 | 15% | 2 |
| Y155F/R338E/T343R/R403E/E410N | Y[155]F/R170E/T175R/R233E/E240N | 5.7 | 1.1 | 20% | 4 |
| Y155F/K247N/N249S/R318Y/R338E/T343R/R403E/E410N | Y[155]F/K82N/N84S/R150Y/R170E/T175R/R233E/E240N | 9.7 | 3.4 | 35% | 11 |
| K247N/N249S/R318Y/R338E/T343R/R403E/E410N | K82N/N84S/R150Y/R170E/T175R/R233E/E240N | 10.6 | 3.6 | 34% | 5 |
| K228N/I251S/R318Y/R338E/R403E/E410N | K63N/I86S/R150Y/R170E/R233E/E240N | 7.5 | 3.3 | 44% | 7 |
| Y155F/K228N/I251S/R318Y/R338E/R403E/E410N | Y[155]F/K63N/I86S/R150Y/R170E/R233E/E240N | 5.3 | 1.9 | 36% | 5 |
| N260S/R318Y/R338E/T343R/R403E/E410N | N95S/R150Y/R170E/T175R/R233E/E240N | 8.9 | 3.6 | 40% | 7 |
| Y155F/N260S/R318Y/R338E/T343R/R403E/E410N | Y[155]F/N95S/R150Y/R170E/T175R/R233E/E240N | 5.8 | 1.6 | 28% | 5 |
| K228N/K247N/N249S/R318Y/R338E/T343R/R403E/E410N | K63N/K82N/N84S/R150Y/R170E/T175R/R233E/E240N | 9.9 | 3.2 | 32% | 12 |
| Y155F/K228N/K247N/N249S/R318Y/R338E/T343R/R403E/E410N | Y[155]F/K63N/K82N/N84S/R150Y/R170E/T175R/R233E/E240N | 9.4 | 2.3 | 25% | 5 |
| Y155F/R338E/T343R/R403E | Y[155]F/R170E/T175R/R233E | 5.2 | 0.9 | 18% | 5 |
| R338E/T343R/R403E | R170E/T175R/R233E | 6.9 | 0.3 | 4% | 2 |
| Y155F/R338E/T343R/R403E/E410S | Y[155]F/R170E/T175R/R233E/E240S | 6.8 | 2.4 | 34% | 6 |
| Y155F/N260S/R338E/T343R/R403E | Y[155]F/N95S/R170E/T175R/R233E | 6.4 | 3.8 | 59% | 6 |
| Y155F/I251S/R338E/T343R/R403E | Y[155]F/I86S/R170E/T175R/R233E | 5.9 | 0.7 | 12% | 2 |
| R318Y/R338E/T343R/R403E/E410S | R150Y/R170E/T175R/R233E/E240S | 7.6 | 1.7 | 22% | 14 |
| Y155F/K247N/N249S/T343R/R403E | Y[155]F/K82N/N84S/T175R/R233E | 4.7 | 0.2 | 5% | 4 |
| Y155F/K247N/N249S/R318Y/R338E/T343R/R403E | Y[155]F/K82N/N84S/R150Y/R170E/T175R/R233E | 10.6 | 0.8 | 8% | 2 |
| K247N/N249S/R318Y/R338E/T343R/R403E | K82N/N84S/R150Y/R170E/T175R/R233E | 9.2 | 3.3 | 36% | 4 |
| Y155F/K247N/N249S/R338E/T343R/R403E/E410N | Y[155]F/K82N/N84S/R170E/T175R/R233E/E240N | 9.8 | 0.7 | 8% | 2 |
| K247N/N249S/R338E/T343R/R403E/E410N | K82N/N84S/R170E/T175R/R233E/E240N | 10.8 | 1.6 | 15% | 2 |
| Y155F/K247N/N249S/R318Y/R338E | Y[155]F/K82N/N84S/R150Y/R170E | 7.5 | 1.5 | 20% | 2 |
| Y155F/K247N/N249S/R318Y/T343R | Y[155]F/K82N/N84S/R150Y/T175R | 10.3 | 3.3 | 32% | 4 |
| Y155F/K247N/N249S/R318Y/R403E | Y[155]F/K82N/N84S/R150Y/R233E | 1.7 | 0.7 | 42% | 3 |
| Y155F/K247N/N249S/R318Y/E410N | Y[155]F/K82N/N84S/R150Y/E240N | 3.4 | 0.9 | 26% | 3 |

TABLE 17-continued

Catalytic activity of FIXa variants ($k_{cat}$)

| Mutation (Mature FIX Numbering) | Mutation (Chymotrypsin Numbering) | $k_{cat}$ (s$^{-1}$) | ±S.D. (s$^{-1}$) | % CV | n |
|---|---|---|---|---|---|
| Y155F/K247N/N249S/R338E/R403E | Y[155]F/K82N/N84S/R170E/R233E | 5.3 | 0.6 | 11% | 2 |
| Y155F/K247N/N249S/R338E/T343R | Y[155]F/K82N/N84S/R170E/T175R | 10.6 | 1.1 | 10% | 2 |
| Y155F/K247N/N249S/R318Y/R338E/T343R/E410N | Y[155]F/K82N/N84S/R150Y/R170E/T175R/E240N | 7.7 | 2.3 | 30% | 4 |
| K247N/N249S/R318Y/R338E/T343R/E410N | K82N/N84S/R150Y/R170E/T175R/E240N | 8.8 | 4.4 | 50% | 6 |
| Y155F/K247N/N249S/R318Y/T343R/R403E/E410N | Y[155]F/K82N/N84S/R150Y/T175R/R233E/E240N | 9.0 | 0.4 | 5% | 2 |
| K247N/N249S/R318Y/T343R/R403E/E410N | K82N/N84S/R150Y/T175R/R233E/E240N | 9.5 | 1.6 | 17% | 7 |
| Y155F/K247N/N249S/R338E/E410N | Y[155]F/K82N/N84S/R170E/E240N | 7.3 | 3.5 | 48% | 8 |
| Y155F/K247N/N249S/R318Y/T343R/R403E | Y[155]F/K82N/N84S/R150Y/T175R/R233E | 7.5 | 2.1 | 28% | 2 |
| K247N/N249S/R318Y/T343R/R403E | K82N/N84S/R150Y/T175R/R233E | 3.7 | 1.6 | 44% | 9 |
| Y155F/K247N/N249S/R318Y/T343R/E410N | Y[155]F/K82N/N84S/R150Y/T175R/E240N | 8.1 | 4.1 | 51% | 4 |
| K247N/N249S/R318Y/T343R/E410N | K82N/N84S/R150Y/T175R/E240N | 6.1 | 2.6 | 42% | 4 |
| Y155F/K247N/N249S/R338E/T343R/R403E | Y[155]F/K82N/N84S/R170E/T175R/R233E | 14.6 | 0.2 | 1% | 2 |
| K247N/N249S/R338E/T343R/R403E | K82N/N84S/R170E/T175R/R233E | 14.6 | 0.4 | 3% | 2 |
| Y155F/K247N/N249S/R338E/T343R/E410N | Y[155]F/K82N/N84S/R170E/T175R/E240N | 4.8 | 1.0 | 20% | 2 |
| K247N/N249S/R338E/T343R/E410N | K82N/N84S/R170E/T175R/E240N | 7.9 | 1.4 | 18% | 5 |
| Y155F/K247N/N249S/T343R/R403E/E410N | Y[155]F/K82N/N84S/T175R/R233E/E240N | 15.0 | 3.0 | 20% | 2 |
| K247N/N249S/T343R/R403E/E410N | K82N/N84S/T175R/R233E/E240N | 8.0 | 2.8 | 36% | 2 |
| Y155F/R318Y/R338E/T343R | Y[155]F/R150Y/R170E/T175R | 7.9 | 3.0 | 38% | 7 |
| R318Y/R338E/T343R | R150Y/R170E/T175R | 4.5 | 1.2 | 27% | 2 |
| Y155F/R318Y/T343R/R403E | Y[155]F/R150Y/T175R/R233E | 5.0 | 1.1 | 22% | 2 |
| Y155F/T343R/R403E/E410N | Y[155]F/T175R/R233E/E240N | 6.6 | 1.4 | 21% | 2 |
| Y155F/K247N/N249S/R318Y/R338E/T343R | Y[155]F/K82N/N84S/R150Y/R170E/T175R | 8.5 | 3.3 | 39% | 7 |
| K247N/N249S/R318Y/R338E/T343R | K82N/N84S/R150Y/R170E/T175R | 8.0 | 1.7 | 22% | 4 |
| Y155F/K247N/N249S/T343R/E410N | Y[155]F/K82N/N84S/T175R/E240N | 7.9 | 1.6 | 20% | 5 |
| Y155F/K247N/N249S/R403E/E410N | Y[155]F/K82N/N84S/R233E/E240N | 2.7 | 1.4 | 52% | 7 |
| Y155F/R338E/T343R/E410N | Y[155]F/R170E/T175R/E240N | 6.0 | 2.2 | 37% | 6 |
| R338E/T343R/E410N | R170E/T175R/E240N | 3.1 | 0.5 | 16% | 2 |
| Y155F/R318Y/T343R/E410N | Y[155]F/R150Y/T175R/E240N | 5.0 | 1.3 | 25% | 4 |
| R318Y/T343R/E410N | R150Y/T175R/E240N | 3.2 | 0.4 | 13% | 2 |
| K228N/R318Y/R338E/T343R/R403E/E410N | K63N/R150Y/R170E/T175R/R233E/E240N | 10.5 | 0.7 | 6% | 3 |
| K228N/K247N/N249S/R318Y/R338E/T343R/R403E | K63N/K82N/N84S/R150Y/R170E/T175R/R233E | 10.9 | 1.4 | 13% | 3 |
| K228N/K247N/N249S/R318Y/R338E/T343R/E410N | K63N/K82N/N84S/R150Y/R170E/T175R/E240N | 4.7 | 0.4 | 8% | 2 |
| K228N/K247N/N249S/R318Y/T343R/R403E/E410N | K63N/K82N/N84S/R150Y/T175R/R233E/E240N | 8.1 | 2.1 | 26% | 3 |

†produced in BHK-21 cells;
*80% glycosylated form of E410N

TABLE 18

Catalytic activity of FIXa variants ($K_M$)

| Mutation (Mature FIX Numbering) | Mutation (Chymotrypsin Numbering) | $K_M$ (nM) | ±S.D. (nM) | % CV | n |
|---|---|---|---|---|---|
| BeneFIX Benefix ® Coagulation FIX (T148A) | BeneFIX Benefix ® Coagulation FIX (T[148]A) | 76.9 | 27.5 | 36% | 125 |
| Plasma Purified FIXa | Plasma Purified FIXa | 74.5 | 25.5 | 34% | 120 |
| Catalyst Biosciences WT | Catalyst Biosciences WT | 74.7 | 23.1 | 31% | 31 |
| N157D | N[157]D | 121.8 | 53.0 | 44% | 2 |
| Y155F | Y[155]F | 90.3 | 10.3 | 11% | 2 |
| A103N/N105S/Y155F | A[103]N/N[105]S/Y[155]F | 80.4 | 2.5 | 3% | 2 |
| D104N/K106S/Y155F | D[104]N/K[106]S/Y[155]F | 81.5 | 5.2 | 6% | 2 |
| A103N/N105S | A[103]N/N[105]S | 88.0 | 22.5 | 26% | 9 |
| D104N/K106S | D[104]N/K[106]S | 83.2 | 18.2 | 22% | 9 |
| K106N/V108S | K[106]N/V[108]S | 91.9 | 20.2 | 22% | 7 |
| D85N | D[85]N | 64.5 | 23.1 | 36% | 15 |
| T148A | T[148]A | 64.5 | 25.1 | 39% | 30 |
| T148A† | T[148]A† | 74.6 | 16.1 | 22% | 7 |
| K5A | K[5]A | 55.0 | 0.3 | 1% | 2 |

TABLE 18-continued

Catalytic activity of FIXa variants ($K_M$)

| Mutation (Mature FIX Numbering) | Mutation (Chymotrypsin Numbering) | $K_M$ (nM) | ±S.D. (nM) | % CV | n |
|---|---|---|---|---|---|
| D64N | D[64]N | 121.4 | 58.8 | 48% | 2 |
| D64A | D[64]A | 129.4 | 36.3 | 28% | 2 |
| N167D | N[167]D | 94.6 | 7.0 | 7% | 2 |
| N167Q | N[167]Q | 77.1 | 35.8 | 46% | 4 |
| S61A | S[61]A | 84.6 | 35.6 | 42% | 4 |
| S53A | S[53]A | 109.9 | 11.6 | 11% | 3 |
| T159A | T[159]A | 100.9 | 1.2 | 1% | 3 |
| T169A | T[169]A | 99.7 | 10.8 | 11% | 3 |
| T172A | T[172]A | 96.2 | 22.1 | 23% | 3 |
| T179A | T[179]A | 94.5 | 16.7 | 18% | 3 |
| Y155H | Y[155]H | 93.9 | 15.8 | 17% | 3 |
| Y155Q | Y[155]Q | 87.6 | 29.8 | 34% | 3 |
| S158A | S[158]A | 107.7 | 0.4 | 0% | 2 |
| S158D | S[158]D | 87.0 | 9.0 | 10% | 2 |
| S158E | S[158]E | 96.0 | 14.1 | 15% | 2 |
| N157Q | N[157]Q | 107.8 | 5.5 | 5% | 2 |
| D203N/F205T | D39N/F41T | 74.3 | 19.5 | 26% | 12 |
| D85N/D203N/F205T | D[85]N/D39N/F41T | 40.6 | 9.1 | 22% | 5 |
| K228N | K63N | 72.5 | 25.5 | 35% | 13 |
| D85N/K228N | D[85]N/K63N | 60.1 | 13.4 | 22% | 6 |
| A103N/N105S/K228N | A[103]N/N[105]S/K63N | 76.5 | 15.8 | 21% | 3 |
| D104N/K106S/K228N | D[104]N/K[106]S/K63N | 96.8 | 21.2 | 22% | 3 |
| Y155F/K228N | Y[155]F/K63N | 73.7 | 3.7 | 5% | 2 |
| D104N/K106S/Y155F/K228N | D[104]N/K[106]S/Y[155]F/K63N | 76.2 | 6.4 | 8% | 2 |
| I251S | I86S | 64.3 | 13.3 | 21% | 13 |
| D85N/I251S | D[85]N/I86S | 51.5 | 15.3 | 30% | 5 |
| D85N/D104N/K106S/I251S | D[85]N/D[104]N/K[106]S/I86S | 46.4 | 19.0 | 41% | 5 |
| A103N/N105S/I251S | A[103]N/N[105]S/I86S | 90.9 | 41.2 | 45% | 3 |
| D104N/K106S/I251S | D[104]N/K[106]S/I86S | 97.5 | 13.8 | 14% | 2 |
| Y155F/I251S | Y[155]F/I86S | 56.4 | 17.5 | 31% | 2 |
| A262S | A95bS | 99.2 | 19.9 | 20% | 8 |
| K413N | K243N | 109.6 | 41.0 | 37% | 5 |
| E410N | E240N | 46.2 | 21.5 | 47% | 21 |
| E410N* | E240N* | 83.3 | 36.9 | 44% | 11 |
| E239N | E74N | 78.3 | 29.5 | 38% | 9 |
| T241N/H243S | T76N/H78S | 104.5 | 3.5 | 3% | 2 |
| K247N/N249S | K82N/N84S | 75.0 | 15.4 | 21% | 11 |
| Y155F/K247N/N249S | Y[155]F/K82N/N84S | 67.1 | 23.6 | 35% | 4 |
| A103N/N105S/K247N/N249S | A[103]N/N[105]S/K82N/N84S | 84.0 | 9.7 | 12% | 6 |
| D104N/K106S/K247N/N249S | D[104]N/K[106]S/K82N/N84S | 102.3 | 23.0 | 23% | 2 |
| D104N/K106S/Y155F/K247N/N249S | D[104]N/K[106]S/Y[155]F/K82N/N84S | 89.3 | 10.3 | 12% | 3 |
| L321N | L153N | 118.5 | 10.6 | 9% | 2 |
| F314N/H315S | F145N/H147S | No Activity | n.d. | n.d. | 4 |
| S319N/L321S | S151N/L153S | 54.2 | 14.8 | 27% | 3 |
| N260S | N95S | 83.4 | 27.5 | 33% | 13 |
| D104N/K106S/N260S | D[104]N/K[106]S/N95S | 94.3 | 6.8 | 7% | 2 |
| Y155F/N260S | Y[155]F/N95S | 130.6 | 78.1 | 60% | 2 |
| D104N/K106S/Y155F/N260S | D[104]N/K[106]S/Y[155]F/N95S | 107.7 | 74.8 | 69% | 2 |
| Y284N | Y117N | 59.8 | 23.5 | 39% | 8 |
| G317N | G149N | No Activity | n.d. | n.d. | 5 |
| R318N/A320S | R150N/A152S | No Activity | n.d. | n.d. | 8 |
| R318A | R150A | 52.8 | 25.8 | 49% | 3 |
| R318E | R150E | 33.6 | 10.3 | 31% | 3 |
| R318Y | R150Y | 40.7 | 7.6 | 19% | 3 |
| R312Q | R143Q | 29.9 | 5.0 | 17% | 3 |
| R312A | R143A | 61.6 | 16.9 | 27% | 2 |
| R312Y | R143Y | 27.2 | 11.4 | 42% | 2 |
| R312L | R143L | 28.8 | 0.6 | 2% | 2 |
| V202M | V38M | 40.2 | 1.0 | 2% | 2 |
| V202Y | V38Y | 70.6 | 2.3 | 3% | 2 |
| D203M | D39M | 40.6 | 7.9 | 19% | 5 |
| D203Y | D39Y | 58.0 | 19.5 | 34% | 4 |
| A204M | A40M | 34.0 | 9.2 | 27% | 5 |
| A204Y | A40Y | 39.5 | 10.3 | 26% | 2 |
| K400A/R403A | K230A/R233A | 56.7 | 10.0 | 18% | 2 |
| K400E/R403E | K230E/R233E | No Activity | n.d. | n.d. | 4 |
| R403A | R233A | 46.4 | 5.2 | 11% | 7 |
| R403E | R233E | 67.0 | 19.4 | 29% | 6 |
| K400A | K230A | 74.6 | 22.1 | 30% | 2 |
| K400E | K230E | 61.3 | 9.3 | 15% | 2 |

TABLE 18-continued

Catalytic activity of FIXa variants ($K_M$)

| Mutation (Mature FIX Numbering) | Mutation (Chymotrypsin Numbering) | $K_M$ (nM) | ±S.D. (nM) | % CV | n |
|---|---|---|---|---|---|
| K293E | K126E | 63.2 | 13.9 | 22% | 2 |
| K293A | K126A | 73.7 | 35.2 | 48% | 2 |
| R333A | R165A | No Activity | n.d. | n.d. | 2 |
| R333E | R165E | No Activity | n.d. | n.d. | 2 |
| R338A | R170A | 33.7 | 3.7 | 11% | 2 |
| R338E | R170E | 28.7 | 9.0 | 31% | 10 |
| R338A/R403A | R170A/R233A | 73.6 | 18.1 | 25% | 6 |
| R338E/R403E | R170E/R233E | 51.9 | 11.9 | 23% | 2 |
| K293A/R403A | K126A/R233A | 69.2 | 10.2 | 15% | 2 |
| K293E/R403E | K126E/R233E | 104.1 | 31.0 | 30% | 2 |
| K293A/R338A/R403A | K126A/R170A/R233A | 65.4 | 1.3 | 2% | 2 |
| K293E/R338E/R403E | K126E/R170E/R233E | 50.0 | 15.1 | 30% | 2 |
| R318A/R403A | R150A/R233A | 45.7 | 1.6 | 3% | 2 |
| R318E/R403E | R150E/R233E | 75.3 | 47.7 | 63% | 2 |
| R318Y/E410N | R150Y/E240N | 49.6 | 14.3 | 29% | 21 |
| R338E/E410N | R170E/E240N | 12.6 | 4.2 | 33% | 8 |
| R338E/R403E/E410N | R170E/R233E/E240N | 45.5 | 12.8 | 28% | 7 |
| R318Y/R338E/R403E | R150Y/R170E/R233E | 53.7 | 1.9 | 4% | 2 |
| D203N/F205T/K228N | D39N/F41T/K63N | 39.9 | 3.8 | 9% | 2 |
| D203N/F205T/E410N | D39N/F41T/E240N | 45.5 | 12.0 | 26% | 6 |
| D203N/F205T/R338E | D39N/F41T/R170E | 24.1 | 5.6 | 23% | 2 |
| D203N/F205T/R338A | D39N/F41T/R170A | 38.5 | 9.9 | 26% | 3 |
| D203N/F205T/R318Y | D39N/F41T/R150Y | 47.5 | 6.4 | 13% | 4 |
| D203N/F205T/R338E/R403E | D39N/F41T/R170E/R233E | 51.1 | 10.7 | 21% | 2 |
| K228N/E410N | K63N/E240N | 44.3 | 13.0 | 29% | 10 |
| K228N/R338E | K63N/R170E | 23.1 | 3.0 | 13% | 2 |
| K228N/R338A | K63N/R170A | 31.2 | 4.5 | 14% | 2 |
| K228N/R318Y | K63N/R150Y | 61.3 | 5.4 | 9% | 5 |
| K228N/R338E/R403E | K63N/R170E/R233E | 59.2 | 4.9 | 8% | 2 |
| R403E/E410N | R233E/E240N | 93.7 | 1.0 | 1% | 2 |
| R318Y/R338E/E410N | R150V/R170E/E240N | 14.2 | 4.3 | 30% | 26 |
| D104N/K106S/R318Y/R338E/E410N | D[104]N/K[106]S/R150Y/R170E/E240N | 18.9 | 4.1 | 22% | 4 |
| Y155F/R318Y/R338E/E410N | Y[155]F/R150Y/R170E/E240N | 16.0 | 4.8 | 30% | 5 |
| K228N/R318Y/E410N | K63N/R150Y/E240N | 42.0 | 4.7 | 11% | 4 |
| R318Y/R403E/E410N | R150Y/R233E/E240N | 88.3 | 12.4 | 14% | 3 |
| R318Y/R338E/R403E/E410N | R150Y/R170E/R233E/E240N | 45.5 | 12.2 | 27% | 14 |
| A103N/N105S/R318Y/R338E/R403E/E410N | A[103]N/N[105]S/R150Y/R170E/R233E/E240N | 44.7 | 20.9 | 47% | 5 |
| D104N/K106S/R318Y/R338E/R403E/E410N | D[104]N/K[106]S/R150Y/R170E/R233E/E240N | 38.5 | 16.1 | 42% | 3 |
| Y155F/R318Y/R338E/R403E/E410N | Y[155]F/R150Y/R170E/R233E/E240N | 30.4 | 10.5 | 35% | 4 |
| A103N/N105S/Y155F/R318Y/R338E/R403E/E410N | A[103]N/N[105]S/Y[155]F/R150Y/R170E/R233E/E240N | 50.7 | 4.5 | 9% | 2 |
| D104N/K106S/Y155F/R318Y/R338E/R403E/E410N | D[104]N/K[106]S/Y[155]F/R150Y/R170E/R233E/E240N | 48.0 | 2.1 | 4% | 2 |
| D203N/F205T/R318Y/E410N | D39N/F41T/R150Y/E240N | 45.7 | 13.4 | 29% | 6 |
| R333S | R165S | 605.9 | 317.5 | 52% | 3 |
| R338L | R170L | 47.9 | 9.0 | 19% | 3 |
| K316N | K148N | 62.5 | 15.6 | 25% | 3 |
| K316A | K148A | 55.2 | 4.1 | 7% | 3 |
| K316E | K148E | 110.5 | 25.1 | 23% | 3 |
| K316S | K148S | 57.3 | 4.6 | 8% | 3 |
| K316M | K148M | 26.0 | 16.7 | 64% | 3 |
| E239S | E74S | 28.5 | 19.2 | 67% | 3 |
| E239A | E74A | 55.4 | 18.4 | 33% | 3 |
| E239R | E74R | 58.3 | 13.9 | 24% | 3 |
| E239K | E74K | 59.2 | 25.5 | 43% | 3 |
| H257F | H92F | 62.0 | 30.1 | 49% | 3 |
| H257Y | H92Y | 59.3 | 25.0 | 42% | 3 |
| H257E | H92E | 59.7 | 39.6 | 66% | 3 |
| H257S | H92S | 56.0 | 24.7 | 44% | 3 |
| T412A | T242A | 76.1 | 44.7 | 59% | 5 |
| T412V | T242V | 51.2 | 18.9 | 37% | 8 |
| E410N/T412A | E240N/T242A | 37.2 | 3.6 | 10% | 4 |
| E410N/T412V | E240N/T242V | 33.3 | 4.9 | 15% | 4 |
| E410Q | E240Q | 56.1 | 18.0 | 32% | 4 |
| E410S | E240S | 50.0 | 11.9 | 24% | 12 |
| E410A | E240A | 47.7 | 11.7 | 24% | 10 |
| E410D | E240D | 71.9 | 26.9 | 37% | 4 |
| N346D | N178D | 45.7 | 7.8 | 17% | 4 |
| Y155F/N346D | Y[155]F/N178D | 104.4 | 14.5 | 14% | 2 |

TABLE 18-continued

Catalytic activity of FIXa variants ($K_M$)

| Mutation (Mature FIX Numbering) | Mutation (Chymotrypsin Numbering) | $K_M$ (nM) | ±S.D. (nM) | % CV | n |
|---|---|---|---|---|---|
| N346Y | N178Y | 27.4 | 4.2 | 15% | 8 |
| Y345A | Y177A | 50.8 | 32.4 | 64% | 4 |
| Y345T | Y177T | 28.6 | 7.9 | 28% | 4 |
| T343R | T175R | 31.3 | 10.9 | 35% | 9 |
| T343E | T175E | 27.3 | 10.0 | 37% | 4 |
| T343Q | T175Q | 37.0 | 9.1 | 25% | 3 |
| F342I | F174I | 30.0 | 19.1 | 64% | 3 |
| T343R/Y345T | T175R/Y177T | 26.5 | 6.8 | 26% | 3 |
| R318Y/R338E | R150Y/R170E | 24.6 | 5.5 | 22% | 4 |
| Y259F/K265T/Y345T | Y94F/K98T/Y177T | 30.9 | 4.8 | 16% | 2 |
| K228N/I251S | K63N/I86S | 122.6 | 53.5 | 44% | 2 |
| K228N/R318Y/R338E/R403E/E410N | K63N/R150Y/R170E/R233E/E240N | 36.1 | 14.0 | 39% | 3 |
| Y155F/K228N/R318Y/R338E/R403E/E410N | Y[155]F/K63N/R150Y/R170E/R233E/E240N | 48.0 | 9.8 | 21% | 2 |
| D85N/K228N/R318Y/R338E/R403E/E410N | D[85]N/K63N/R150Y/R170E/R233E/E240N | 39.3 | 9.8 | 25% | 2 |
| I251S/R318Y/R338E/R403E/E410N | I86S/R150Y/R170E/R233E/E240N | 33.4 | 10.2 | 30% | 4 |
| D104N/K106S/I251S/R318Y/R338E/R403E/E410N | D[104]N/K[106]S/I86S/R150Y/R170E/R233E/E240N | 46.2 | 7.7 | 17% | 8 |
| Y155F/I251S/R318Y/R338E/R403E/E410N | Y[155]F/I86S/R150Y/R170E/R233E/E240N | 43.3 | 7.0 | 16% | 2 |
| I251S/R318Y/R338E/E410N | I86S/R150Y/R170E/E240N | 16.2 | 1.8 | 11% | 7 |
| D104N/K106S/I251S/R318Y/R338E/E410N | D[104]N/K[106]S/I86S/R150Y/R170E/E240N | 24.3 | 8.6 | 35% | 3 |
| F314N/K316S | F145N/K148S | 635.1 | 569.9 | 90% | 2 |
| K247N/N249S/R318Y/R338E/R403E/E410N | K82N/N84S/R150Y/R170E/R233E/E240N | 39.2 | 8.3 | 21% | 6 |
| Y155F/K247N/N249S/R318Y/R338E/R403E/E410N | Y[155]F/K82N/N84S/R150Y/R170E/R233E/E240N | 39.1 | 14.7 | 38% | 6 |
| A103N/N105S/K247N/N249S/R318Y/R338E/R403E/E410N | A[103]N/N[105]S/K82N/N84S/R150Y/R170E/R233E/E240N | 39.7 | 4.5 | 11% | 2 |
| D104N/K106S/K247N/N249S/R318Y/R338E/R403E/E410N | D[104]N/K[106]S/K82N/N84S/R150Y/R170E/R233E/E240N | 59.0 | 0.6 | 1% | 2 |
| K247N/N249S/R318Y/R338E/E410N | K82N/N84S/R150Y/R170E/E240N | 16.6 | 3.7 | 22% | 6 |
| Y155F/K247N/N249S/R318Y/R338E/E410N | Y[155]F/K82N/N84S/R150Y/R170E/E240N | 15.3 | 4.1 | 27% | 7 |
| R318Y/R338E/R403E/E410S | R150Y/R170E/R233E/E240S | 35.1 | 12.4 | 35% | 4 |
| R318Y/R338E/E410S | R150Y/R170E/E240S | 16.4 | 4.0 | 25% | 8 |
| K228N/K247N/N249S | K63N/K82N/N84S | 94.5 | 27.0 | 29% | 2 |
| D104N/K106S/Y155F/K228N/K247N/N249S | D[104]N/K[106]S/Y[155]F/K63N/K82N/N84S | 75.3 | 26.4 | 35% | 2 |
| D104N/K106S/K228N/K247N/N249S | D[104]N/K[106]S/K63N/K82N/N84S | 77.1 | 18.3 | 24% | 5 |
| Y155F/K228N/K247N/N249S | Y[155]F/K63N/K82N/N84S | 79.2 | 27.6 | 35% | 2 |
| K228N/K247N/N249S/R318Y/R338E/R403E/E410N | K63N/K82N/N84S/R150Y/R170E/R233E/E240N | 55.8 | 15.8 | 28% | 3 |
| R318Y/R338E/R403E/E410N/T412V | R150Y/R170E/R233E/E240N/T242V | 44.3 | 19.2 | 43% | 4 |
| R318Y/R338E/R403E/E410N/T412A | R150Y/R170E/R233E/E240N/T242A | 33.5 | 4.8 | 14% | 4 |
| R318Y/R338E/R403E/T412A | R150Y/R170E/R233E/T242A | 67.5 | 11.6 | 17% | 4 |
| R318Y/R338E/T412A | R150Y/R170E/T242A | 23.5 | 5.3 | 22% | 6 |
| R318Y/R338E/E410N/T412V | R150Y/R170E/E240N/T242V | 29.7 | 10.9 | 37% | 4 |
| N260S/R318Y/R338E/R403E/E410N | N95S/R150Y/R170E/R233E/E240N | 72.4 | 20.2 | 28% | 2 |
| D104N/K106S/N260S/R318Y/R338E/R403E/E410N | D[104]N/K[106]S/N95S/R150Y/R170E/R233E/E240N | 61.1 | 0.0 | 0% | 2 |
| Y155F/N260S/R318Y/R338E/R403E/E410N | Y[155]F/N95S/R150Y/R170E/R233E/E240N | 83.9 | 4.4 | 5% | 2 |
| R318Y/R338E/N346D/R403E/E410N | R150Y/R170E/N178D/R233E/E240N | 77.7 | 20.9 | 27% | 2 |
| Y155F/R318Y/R338E/N346D/R403E/E410N | Y[155]F/R150Y/R170E/N178D/R233E/E240N | 100.0 | 15.6 | 16% | 2 |
| K247N/N249S/N260S | K82N/N84S/N95S | 114.1 | 0.0 | 0% | 2 |
| Y155F/K247N/N249S/N260S | Y[155]F/K82N/N84S/N95S | 96.5 | 5.5 | 6% | 2 |
| D104N/K106S/K247N/N249S/N260S | D[104]N/K[106]S/K82N/N84S/N95S | 61.2 | 14.1 | 23% | 2 |
| D104N/K106S/Y155F/K247N/N249S/N260S | D[104]N/K[106]S/Y[155]F/K82N/N84S/N95S | 68.5 | 33.2 | 49% | 2 |
| K247N/N249S/N260S/R318Y/R338E/R403E/E410N | K82N/N84S/N95S/R150Y/R170E/R233E/E240N | 62.2 | 0.0 | 0% | 2 |
| Y155F/N260S/N346D | Y[155]F/N95S/N178D | 127.9 | 6.2 | 5% | 2 |

TABLE 18-continued

Catalytic activity of FIXa variants ($K_M$)

| Mutation (Mature FIX Numbering) | Mutation (Chymotrypsin Numbering) | $K_M$ (nM) | ±S.D. (nM) | % CV | n |
|---|---|---|---|---|---|
| R318Y/R338E/T343R/R403E/E410N | R150Y/R170E/T175R/R233E/E240N | 22.3 | 5.0 | 23% | 3 |
| R338E/T343R | R170E/T175R | 13.6 | 3.7 | 27% | 4 |

†produced in BHK-21 cells;
*80% glycosylated form of E410N

TABLE 19

Catalytic activity of FIXa variants ($K_M$)

| Mutation (Mature FIX Numbering) | Mutation (Chymotrypsin Numbering) | $K_M$ (nM) | ±S.D. (nM) | % CV | n |
|---|---|---|---|---|---|
| BeneFIX Benefix ® Coagulation FIX (T148A) | BeneFIX Benefix ® Coagulation FIX (T[148]A) | 75.8 | 27.2 | 36% | 140 |
| Plasma Purified FIXa | Plasma Purified FIXa | 73.3 | 26.8 | 37% | 200 |
| Catalyst Biosciences WT | Catalyst Biosciences WT | 72.3 | 24.3 | 34% | 33 |
| N157D | N[157]D | 121.8 | 53.0 | 44% | 2 |
| Y155F | Y[155]F | 90.3 | 10.3 | 11% | 2 |
| A103N/N105S/Y155F | A[103]N/N[105]S/Y[155]F | 80.4 | 2.5 | 3% | 2 |
| D104N/K106S/Y155F | D[104]N/K[106]S/Y[155]F | 81.5 | 5.2 | 6% | 2 |
| A103N/N105S | A[103]N/N[105]S | 88.0 | 22.5 | 26% | 9 |
| D104N/K106S | D[104]N/K[106]S | 83.2 | 18.2 | 22% | 9 |
| K106N/V108S | K[106]N/V[108]S | 91.9 | 20.2 | 22% | 7 |
| D85N | D[85]N | 64.5 | 21.9 | 34% | 17 |
| T148A | T[148]A | 70.1 | 26.9 | 38% | 44 |
| T148A† | T[148]A† | 74.6 | 16.1 | 22% | 7 |
| K5A | K[5]A | 65.4 | 26.8 | 41% | 4 |
| D64N | D[64]N | 121.4 | 58.8 | 48% | 2 |
| D64A | D[64]A | 129.4 | 36.3 | 28% | 2 |
| N167D | N[167]D | 94.6 | 7.0 | 7% | 2 |
| N167Q | N[167]Q | 77.1 | 35.8 | 46% | 4 |
| S61A | S[61]A | 84.6 | 35.6 | 42% | 4 |
| S53A | S[53]A | 109.9 | 11.6 | 11% | 3 |
| T159A | T[159]A | 100.9 | 1.2 | 1% | 3 |
| T169A | T[169]A | 99.7 | 10.8 | 11% | 3 |
| T172A | T[172]A | 96.2 | 22.1 | 23% | 3 |
| T179A | T[179]A | 94.5 | 16.7 | 18% | 3 |
| Y155H | Y[155]H | 93.9 | 15.8 | 17% | 3 |
| Y155Q | Y[155]Q | 87.6 | 29.8 | 34% | 3 |
| S158A | S[158]A | 107.7 | 0.4 | 0% | 2 |
| S158D | S[158]D | 87.0 | 9.0 | 10% | 2 |
| S158E | S[158]E | 96.0 | 14.1 | 15% | 2 |
| N157Q | N[157]Q | 107.8 | 5.5 | 5% | 2 |
| D203N/F205T | D39N/F41T | 74.3 | 19.5 | 26% | 12 |
| D85N/D203N/F205T | D[85]N/D39N/F41T | 40.6 | 9.1 | 22% | 5 |
| K228N | K63N | 72.5 | 25.5 | 35% | 13 |
| D85N/K228N | D[85]N/K63N | 60.1 | 13.4 | 22% | 6 |
| A103N/N105S/K228N | A[103]N/N[105]S/K63N | 76.5 | 15.8 | 21% | 3 |
| D104N/K106S/K228N | D[104]N/K[106]S/K63N | 96.8 | 21.2 | 22% | 3 |
| Y155F/K228N | Y[155]F/K63N | 73.7 | 3.7 | 5% | 2 |
| D104N/K106S/Y155F/K228N | D[104]N/K[106]S/Y[155]F/K63N | 76.2 | 6.4 | 8% | 2 |
| I251S | I86S | 64.3 | 13.3 | 21% | 13 |
| D85N/I251S | D[85]N/I86S | 51.5 | 15.3 | 30% | 5 |
| D85N/D104N/K106S/I251S | D[85]N/D[104]N/K[106]S/I86S | 46.4 | 19.0 | 41% | 5 |
| A103N/N105S/I251S | A[103]N/N[105]S/I86S | 90.9 | 41.2 | 45% | 3 |
| D104N/K106S/I251S | D[104]N/K[106]S/I86S | 97.5 | 13.8 | 14% | 2 |
| Y155F/I251S | Y[155]F/I86S | 56.4 | 17.5 | 31% | 2 |
| A262S | A95bS | 99.2 | 19.9 | 20% | 8 |
| K413N | K243N | 106.3 | 40.4 | 38% | 7 |
| E410N | E240N | 45.9 | 19.1 | 42% | 27 |
| E410N* | E240N* | 85.2 | 38.1 | 45% | 10 |
| E239N | E74N | 78.3 | 29.5 | 38% | 9 |
| T241N/H243S | T76N/H78S | 104.5 | 3.5 | 3% | 2 |
| K247N/N249S | K82N/N84S | 75.0 | 15.4 | 21% | 11 |
| Y155F/K247N/N249S | Y[155]F/K82N/N84S | 67.1 | 23.6 | 35% | 4 |
| A103N/N105S/K247N/N249S | A[103]N/N[105]S/K82N/N84S | 84.0 | 9.7 | 12% | 6 |
| D104N/K106S/K247N/N249S | D[104]N/K[106]S/K82N/N84S | 102.3 | 23.0 | 23% | 2 |
| D104N/K106S/Y155F/K247N/N249S | D[104]N/K[106]S/Y[155]F/K82N/N84S | 89.3 | 10.3 | 12% | 3 |
| L321N | L153N | 118.5 | 10.6 | 9% | 2 |
| F314N/H315S | F145N/H147S | 93.0 | 14.3 | 15% | 2 |
| K392N/K394S | K222N/K224S | 0.0 | n.d. | n.d. | 0 |

TABLE 19-continued

Catalytic activity of FIXa variants ($K_M$)

| Mutation (Mature FIX Numbering) | Mutation (Chymotrypsin Numbering) | $K_M$ (nM) | ±S.D. (nM) | % CV | n |
|---|---|---|---|---|---|
| S319N/L321S | S151N/L153S | 54.2 | 14.8 | 27% | 3 |
| N260S | N95S | 83.4 | 27.5 | 33% | 13 |
| D104N/K106S/N260S | D[104]N/K[106]S/N95S | 94.3 | 6.8 | 7% | 2 |
| Y155F/N260S | Y[155]F/N95S | 130.6 | 78.1 | 60% | 2 |
| D104N/K106S/Y155F/N260S | D[104]N/K[106]S/Y[155]F/N95S | 107.7 | 74.8 | 69% | 2 |
| Y284N | Y117N | 59.8 | 23.5 | 39% | 8 |
| G317N | G149N | 104.6 | n.d. | n.d. | 1 |
| R318N/A320S | R150N/A152S | 84.5 | 21.2 | 25% | 3 |
| R318A | R150A | 62.3 | 28.2 | 45% | 2 |
| R318E | R150E | 33.6 | 10.3 | 31% | 3 |
| R318Y | R150Y | 40.7 | 7.6 | 19% | 3 |
| R312Q | R143Q | 29.9 | 5.0 | 17% | 3 |
| R312A | R143A | 61.6 | 16.9 | 27% | 2 |
| R312Y | R143Y | 27.2 | 11.4 | 42% | 2 |
| R312L | R143L | 28.8 | 0.6 | 2% | 2 |
| V202M | V38M | 40.2 | 1.0 | 2% | 2 |
| V202Y | V38Y | 70.6 | 2.3 | 3% | 2 |
| D203M | D39M | 40.6 | 7.9 | 19% | 5 |
| D203Y | D39Y | 58.0 | 19.5 | 34% | 4 |
| A204M | A40M | 34.0 | 9.2 | 27% | 5 |
| A204Y | A40Y | 39.5 | 10.3 | 26% | 2 |
| K400A/R403A | K230A/R233A | 56.7 | 10.0 | 18% | 2 |
| K400E/R403E | K230E/R233E | 137.1 | 68.4 | 50% | 3 |
| R403A | R233A | 46.4 | 5.2 | 11% | 7 |
| R403E | R233E | 67.0 | 19.4 | 29% | 6 |
| K400A | K230A | 74.6 | 22.1 | 30% | 2 |
| K400E | K230E | 61.3 | 9.3 | 15% | 2 |
| K293E | K126E | 63.2 | 13.9 | 22% | 2 |
| K293A | K126A | 73.7 | 35.2 | 48% | 2 |
| R333A | R165A | 406.7 | 117.5 | 29% | 2 |
| R333E | R165E | 437.3 | n.d. | n.d. | 1 |
| R338A | R170A | 33.7 | 3.7 | 11% | 2 |
| R338E | R170E | 28.7 | 9.0 | 31% | 10 |
| R338A/R403A | R170A/R233A | 73.6 | 18.1 | 25% | 6 |
| R338E/R403E | R170E/R233E | 51.9 | 11.9 | 23% | 2 |
| K293A/R403A | K126A/R233A | 69.2 | 10.2 | 15% | 2 |
| K293E/R403E | K126E/R233E | 104.1 | 31.0 | 30% | 2 |
| K293A/R338A/R403A | K126A/R170A/R233A | 65.4 | 1.3 | 2% | 2 |
| K293E/R338E/R403E | K126E/R170E/R233E | 50.0 | 15.1 | 30% | 2 |
| R318A/R403A | R150A/R233A | 45.7 | 1.6 | 3% | 2 |
| R318E/R403E | R150E/R233E | 75.3 | 47.7 | 63% | 2 |
| R318Y/E410N | R150Y/E240N | 49.6 | 14.3 | 29% | 21 |
| R338E/E410N | R170E/E240N | 12.6 | 3.5 | 28% | 12 |
| R338E/R403E/E410N | R170E/R233E/E240N | 36.7 | 12.2 | 33% | 17 |
| Y155F/R338E/R403E/E410N | Y[155]F/R170E/R233E/E240N | 33.6 | 8.6 | 26% | 2 |
| R318Y/R338E/R403E | R150Y/R170E/R233E | 59.7 | 10.4 | 17% | 3 |
| Y155F/R318Y/R338E/R403E | Y[155]F/R150Y/R170E/R233E | 67.1 | 27.9 | 42% | 2 |
| D203N/F205T/K228N | D39N/F41T/K63N | 39.9 | 3.8 | 9% | 2 |
| D203N/F205T/E410N | D39N/F41T/E240N | 45.5 | 12.0 | 26% | 6 |
| D203N/F205T/R338E | D39N/F41T/R170E | 24.1 | 5.6 | 23% | 2 |
| D203N/F205T/R338A | D39N/F41T/R170A | 38.5 | 9.9 | 26% | 3 |
| D203N/F205T/R318Y | D39N/F41T/R150Y | 47.5 | 6.4 | 13% | 4 |
| D203N/F205T/R338E/R403E | D39N/F41T/R170E/R233E | 51.1 | 10.7 | 21% | 2 |
| K228N/E410N | K63N/E240N | 44.3 | 13.0 | 29% | 10 |
| K228N/R338E | K63N/R170E | 23.1 | 3.0 | 13% | 2 |
| K228N/R338A | K63N/R170A | 31.2 | 4.5 | 14% | 2 |
| K228N/R318Y | K63N/R150Y | 61.3 | 5.4 | 9% | 5 |
| K228N/R338E/R403E | K63N/R170E/R233E | 59.2 | 4.9 | 8% | 2 |
| R403E/E410N | R233E/E240N | 93.7 | 1.0 | 1% | 2 |
| R318Y/R338E/E410N | R150Y/R170E/E240N | 13.9 | 4.0 | 29% | 42 |
| D104N/K106S/R318Y/R338E/E410N | D[104]N/K[106]S/R150Y/R170E/E240N | 18.9 | 4.1 | 22% | 4 |
| Y155F/R318Y/R338E/E410N | Y[155]F/R150Y/R170E/E240N | 16.0 | 4.8 | 30% | 5 |
| K228N/R318Y/E410N | K63N/R150Y/E240N | 42.0 | 4.7 | 11% | 4 |
| R318Y/R403E/E410N | R150Y/R233E/E240N | 94.2 | 21.1 | 22% | 5 |
| Y155F/R318Y/R403E/E410N | Y[155]F/R150Y/R233E/E240N | 111.4 | 74.7 | 67% | 2 |
| R318Y/R338E/R403E/E410N | R150Y/R170E/R233E/E240N | 43.2 | 13.8 | 32% | 26 |
| A103N/N105S/R318Y/R338E/R403E/E410N | A[103]N/N[105]S/R150Y/R170E/R233E/E240N | 44.7 | 20.9 | 47% | 5 |
| D104N/K106S/R318Y/R338E/R403E/E410N | D[104]N/K[106]S/R150Y/R170E/R233E/E240N | 38.5 | 16.1 | 42% | 3 |
| Y155F/R318Y/R338E/R403E/E410N | Y[155]F/R150Y/R170E/R233E/E240N | 30.4 | 10.5 | 35% | 4 |
| A103N/N105S/Y155F/R318Y/R338E/R403E/E410N | A[103]N/N[105]S/Y[155]F/R150Y/R170E/R233E/E240N | 50.7 | 4.5 | 9% | 2 |
| D104N/K106S/Y155F/R318Y/R338E/R403E/E410N | D[104]N/K[106]S/Y[155]F/R150Y/R170E/R233E/E240N | 48.0 | 2.1 | 4% | 2 |

TABLE 19-continued

Catalytic activity of FIXa variants ($K_M$)

| Mutation (Mature FIX Numbering) | Mutation (Chymotrypsin Numbering) | $K_M$ (nM) | ±S.D. (nM) | % CV | n |
|---|---|---|---|---|---|
| D203N/F205T/R318Y/E410N | D39N/F41T/R150Y/E240N | 45.7 | 13.4 | 29% | 6 |
| R333S | R165S | 605.9 | 317.5 | 52% | 3 |
| R338L | R170L | 47.9 | 9.0 | 19% | 3 |
| K316N | K148N | 62.5 | 15.6 | 25% | 3 |
| K316A | K148A | 55.2 | 4.1 | 7% | 3 |
| K316E | K148E | 110.5 | 25.1 | 23% | 3 |
| K316S | K148S | 57.3 | 4.6 | 8% | 3 |
| K316M | K148M | 26.0 | 16.7 | 64% | 3 |
| E239S | E74S | 28.5 | 19.2 | 67% | 3 |
| E239A | E74A | 55.4 | 18.4 | 33% | 3 |
| E239R | E74R | 58.3 | 13.9 | 24% | 3 |
| E239K | E74K | 59.2 | 25.5 | 43% | 3 |
| H257F | H92F | 62.0 | 30.1 | 49% | 3 |
| H257Y | H92Y | 59.3 | 25.0 | 42% | 3 |
| H257E | H92E | 59.7 | 39.6 | 66% | 3 |
| H257S | H92S | 56.0 | 24.7 | 44% | 3 |
| T412A | T242A | 76.1 | 44.7 | 59% | 5 |
| T412V | T242V | 51.2 | 18.9 | 37% | 8 |
| E410N/T412A | E240N/T242A | 37.2 | 3.6 | 10% | 4 |
| E410N/T412V | E240N/T242V | 33.3 | 4.9 | 15% | 4 |
| E410Q | E240Q | 56.1 | 18.0 | 32% | 4 |
| E410S | E240S | 50.0 | 11.9 | 24% | 12 |
| E410A | E240A | 47.7 | 11.7 | 24% | 10 |
| E410D | E240D | 71.9 | 26.9 | 37% | 4 |
| N346D | N178D | 45.7 | 7.8 | 17% | 4 |
| Y155F/N346D | Y[155]F/N178D | 104.4 | 14.5 | 14% | 2 |
| N346Y | N178Y | 27.4 | 4.2 | 15% | 8 |
| Y345A | Y177A | 50.8 | 32.4 | 64% | 4 |
| Y345T | Y177T | 28.6 | 7.9 | 28% | 4 |
| T343R | T175R | 34.5 | 11.8 | 34% | 12 |
| T343E | T175E | 27.3 | 10.0 | 37% | 4 |
| T343Q | T175Q | 37.0 | 9.1 | 25% | 3 |
| F342I | F174I | 30.0 | 19.1 | 64% | 3 |
| T343R/Y345T | T175R/Y177T | 26.5 | 6.8 | 26% | 3 |
| R318Y/R338E | R150Y/R170E | 24.6 | 5.5 | 22% | 4 |
| Y259F/K265T/Y345T | Y94F/K98T/Y177T | 30.9 | 4.8 | 16% | 2 |
| K228N/I251S | K63N/I86S | 122.6 | 53.5 | 44% | 2 |
| K228N/R318Y/R338E/R403E/E410N | K63N/R150Y/R170E/R233E/E240N | 36.1 | 14.0 | 39% | 3 |
| Y155F/K228N/R318Y/R338E/R403E/E410N | Y[155]F/K63N/R150Y/R170E/R233E/E240N | 40.8 | 15.0 | 37% | 5 |
| D85N/K228N/R318Y/R338E/R403E/E410N | D[85]N/K63N/R150Y/R170E/R233E/E240N | 39.3 | 9.8 | 25% | 2 |
| I251S/R318Y/R338E/R403E/E410N | I86S/R150Y/R170E/R233E/E240N | 33.4 | 10.2 | 30% | 4 |
| D104N/K106S/I251S/R318Y/R338E/R403E/E410N | D[104]N/K[106]S/I86S/R150Y/R170E/R233E/E240N | 46.2 | 7.7 | 17% | 8 |
| Y155F/I251S/R318Y/R338E/R403E/E410N | D[104]N/K[106]S/I86S/R150Y/R170E/R233E/E240N | 43.3 | 7.0 | 16% | 2 |
| I251S/R318Y/R338E/E410N | I86S/R150Y/R170E/E240N | 16.1 | 2.7 | 17% | 10 |
| D104N/K106S/I251S/R318Y/R338E/E410N | D[104]N/K[106]S/I86S/R150Y/R170E/E240N | 24.3 | 8.6 | 35% | 3 |
| F314N/K316S | F145N/K148S | 635.1 | 569.9 | 90% | 2 |
| K247N/N249S/R318Y/R338E/R403E/E410N | K82N/N84S/R150Y/R170E/R233E/E240N | 39.2 | 8.3 | 21% | 6 |
| Y155F/K247N/N249S/R318Y/R338E/R403E/E410N | Y[155]F/K82N/N84S/R150Y/R170E/R233E/E240N | 36.3 | 12.8 | 35% | 10 |
| A103N/N105S/K247N/N249S/R318Y/R338E/R403E/E410N | A[103]N/N[105]S/K82N/N84S/R150Y/R170E/R233E/E240N | 28.0 | 9.5 | 34% | 6 |
| D104N/K106S/K247N/N249S/R318Y/R338E/R403E/E410N | D[104]N/K[106]S/K82N/N84S/R150Y/R170E/R233E/E240N | 59.0 | 0.6 | 1% | 2 |
| D104N/K106S/Y155F/K247N/N249S/R318Y/R338E/R403E/E410N | D[104]N/K[106]S/Y[155]F/K82N/N84S/R150Y/R170E/R233E/E240N | 51.8 | 16.7 | 32% | 6 |
| K247N/N249S/R318Y/R338E/E410N | K82N/N84S/R150Y/R170E/E240N | 16.6 | 3.7 | 22% | 6 |
| Y155F/K247N/N249S/R318Y/R338E/E410N | Y[155]F/K82N/N84S/R150Y/R170E/E240N | 14.7 | 3.9 | 27% | 9 |
| R318Y/R338E/R403E/E410S | R150Y/R170E/R233E/E240S | 36.4 | 9.5 | 26% | 7 |
| R318Y/R338E/E410S | R150Y/R170E/E240S | 16.4 | 4.0 | 25% | 8 |
| K228N/K247N/N249S | K63N/K82N/N84S | 94.5 | 27.0 | 29% | 2 |
| D104N/K106S/Y155F/K228N/K247N/N249S | D[104]N/K[106]S/Y[155]F/K63N/K82N/N84S | 75.3 | 26.4 | 35% | 2 |
| D104N/K106S/K228N/K247N/N249S | D[104]N/K[106]S/K63N/K82N/N84S | 77.1 | 18.3 | 24% | 5 |
| Y155F/K228N/K247N/N249S | Y[155]F/K63N/K82N/N84S | 79.2 | 27.6 | 35% | 2 |
| K228N/K247N/N249S/R318Y/R338E/R403E/E410N | K63N/K82N/N84S/R150Y/R170E/R233E/E240N | 49.7 | 15.6 | 31% | 17 |
| D104N/K106S/K228N/K247N/N249S/R318Y/R338E/R403E/E410N | D[104]N/K[106]S/K63N/K82N/N84S/R150Y/R170E/R233E/E240N | 53.3 | 12.2 | 23% | 7 |

TABLE 19-continued

Catalytic activity of FIXa variants ($K_M$)

| Mutation (Mature FIX Numbering) | Mutation (Chymotrypsin Numbering) | $K_M$ (nM) | ±S.D. (nM) | % CV | n |
|---|---|---|---|---|---|
| Y155F/K228N/K247N/N249S/R318Y/R338E/R403E/E410N | Y[155]F/K63N/K82N/N84S/R150Y/R170E/R233E/E240N | 45.4 | 17.7 | 39% | 5 |
| R318Y/R338E/R403E/E410N/T412V | R150Y/R170E/R233E/E240N/T242V | 48.3 | 16.2 | 33% | 6 |
| R318Y/R338E/R403E/E410N/T412A | R150Y/R170E/R233E/E240N/T242A | 34.4 | 10.0 | 29% | 6 |
| R318Y/R338E/R403E/T412A | R150Y/R170E/R233E/T242A | 67.5 | 11.6 | 17% | 4 |
| R318Y/R338E/T412A | R150Y/R170E/T242A | 23.5 | 5.3 | 22% | 6 |
| R318Y/R338E/E410N/T412V | R150Y/R170E/E240N/T242V | 23.6 | 12.3 | 52% | 11 |
| N260S/R318Y/R338E/R403E/E410N | N95S/R150Y/R170E/R233E/E240N | 72.4 | 20.2 | 28% | 2 |
| D104N/K106S/N260S/R318Y/R338E/R403E/E410N | D[104]N/K[106]S/N95S/R150Y/R170E/R233E/E240N | 61.1 | 0.0 | 0% | 2 |
| Y155F/N260S/R318Y/R338E/R403E/E410N | Y[155]F/N95S/R150Y/R170E/R233E/E240N | 83.9 | 4.4 | 5% | 2 |
| R318Y/R338E/N346D/R403E/E410N | R150Y/R170E/N178D/R233E/E240N | 77.7 | 20.9 | 27% | 2 |
| Y155F/R318Y/R338E/N346D/R403E/E410N | Y[155]F/R150Y/R170E/N178D/R233E/E240N | 100.0 | 15.6 | 16% | 2 |
| K247N/N249S/N260S | K82N/N84S/N95S | 114.1 | 0.0 | 0% | 2 |
| Y155F/K247N/N249S/N260S | Y[155]F/K82N/N84S/N95S | 96.5 | 5.5 | 6% | 2 |
| D104N/K106S/K247N/N249S/N260S | D[104]N/K[106]S/K82N/N84S/N95S | 61.2 | 14.1 | 23% | 2 |
| D104N/K106S/Y155F/K247N/N249S/N260S | D[104]N/K[106]S/Y[155]F/K82N/N84S/N95S | 68.5 | 33.2 | 49% | 2 |
| K247N/N249S/N260S/R318Y/R338E/R403E/E410N | K82N/N84S/N95S/R150Y/R170E/R233E/E240N | 47.4 | 12.1 | 26% | 6 |
| Y155F/K247N/N249S/N260S/R318Y/R338E/R403E/E410N | Y[155]F/K82N/N84S/N95S/R150Y/R170E/R233E/E240N | 95.4 | 73.0 | 77% | 5 |
| Y155F/N260S/N346D | Y[155]F/N95S/N178D | 127.9 | 6.2 | 5% | 2 |
| R318Y/R338E/T343R/R403E/E410N | R150Y/R170E/T175R/R233E/E240N | 24.7 | 7.2 | 29% | 13 |
| Y155F/R318Y/R338E/T343R/R403E/E410N | Y[155]F/R150Y/R170E/T175R/R233E/E240N | 27.2 | 5.7 | 21% | 4 |
| D104N/K106S/R318Y/R338E/T343R/R403E/E410N | D[104]N/K[106]S/R150Y/R170E/T175R/R233E/E240N | 26.6 | 5.0 | 19% | 5 |
| R338E/T343R | R170E/T175R | 14.3 | 3.6 | 25% | 7 |
| T343R/N346Y | T175R/N178Y | 26.0 | 7.3 | 28% | 11 |
| R318Y/R338E/N346Y/R403E/E410N | R150Y/R170E/N178Y/R233E/E240N | 28.1 | 7.5 | 27% | 3 |
| R318Y/R338E/T343R/N346Y/R403E/E410N | R150Y/R170E/T175R/N178Y/R233E/E240N | 15.8 | 4.0 | 25% | 5 |
| T343R/N346D | T175R/N178D | 118.5 | 42.9 | 36% | 2 |
| R318Y/R338E/T343R/N346D/R403E/E410N | R150Y/R170E/T175R/N178D/R233E/E240N | 67.0 | 26.8 | 40% | 2 |
| R318Y/R338E/Y345A/R403E/E410N | R150Y/R170E/Y177A/R233E/E240N | 18.8 | 8.8 | 47% | 6 |
| R318Y/R338E/Y345A/N346D/R403E/E410N | R150Y/R170E/Y177A/N178D/R233E/E240N | 56.5 | 16.1 | 28% | 3 |
| Y155F/K247N/N249S/R318Y/R338E/R403E | Y[155]F/K82N/N84S/R150Y/R170E/R233E | 67.3 | 17.7 | 26% | 5 |
| K247N/N249S/R318Y/R338E/R403E | K82N/N84S/R150Y/R170E/R233E | 53.6 | 22.1 | 41% | 2 |
| Y155F/K247N/N249S/R318Y/R403E/E410N | Y[155]F/K82N/N84S/R150Y/R233E/E240N | 125.4 | 9.1 | 7% | 3 |
| K247N/N249S/R318Y/R403E/E410N | K82N/N84S/R150Y/R233E/E240N | 110.9 | 29.5 | 27% | 10 |
| Y155F/K247N/N249S/R338E/R403E/E410N | Y[155]F/K82N/N84S/R170E/R233E/E240N | 48.7 | 11.4 | 23% | 3 |
| K247N/N249S/R338E/R403E/E410N | K82N/N84S/R170E/R233E/E240N | 25.0 | 7.9 | 31% | 2 |
| R318Y/R338E/T343R/R403E | R150Y/R170E/T175R/R233E | 44.3 | 11.0 | 25% | 4 |
| Y155F/R318Y/R338E/T343R/R403E | Y[155]F/R150Y/R170E/T175R/R233E | 34.0 | 8.7 | 26% | 4 |
| R318Y/R338E/T343R/E410N | R150Y/R170E/T175R/E240N | 16.4 | 5.9 | 36% | 16 |
| Y155F/R318Y/R338E/T343R/E410N | Y[155]F/R150Y/R170E/T175R/E240N | 25.6 | 5.4 | 21% | 4 |
| R318Y/T343R/R403E/E410N | R150Y/T175R/R233E/E240N | 93.9 | 14.0 | 15% | 3 |
| Y155F/R318Y/T343R/R403E/E410N | Y[155]F/R150Y/T175R/R233E/E240N | 34.0 | 7.7 | 23% | 2 |
| R338E/T343R/R403E/E410N | R170E/T175R/R233E/E240N | 34.7 | 14.3 | 41% | 2 |
| Y155F/R338E/T343R/R403E/E410N | Y[155]F/R170E/T175R/R233E/E240N | 25.9 | 8.2 | 32% | 4 |
| Y155F/K247N/N249S/R318Y/R338E/T343R/R403E/E410N | Y[155]F/K82N/N84S/R150Y/R170E/T175R/R233E/E240N | 25.7 | 8.4 | 33% | 11 |
| K247N/N249S/R318Y/R338E/T343R/R403E/E410N | K82N/N84S/R150Y/R170E/T175R/R233E/E240N | 29.2 | 7.9 | 27% | 5 |
| K228N/I251S/R318Y/R338E/R403E/E410N | K63N/I86S/R150Y/R170E/R233E/E240N | 36.4 | 10.8 | 30% | 7 |
| Y155F/K228N/I251S/R318Y/R338E/R403E/E410N | Y[155]F/K63N/I86S/R150Y/R170E/R233E/E240N | 39.3 | 7.3 | 19% | 5 |
| N260S/R318Y/R338E/T343R/R403E/E410N | N95S/R150Y/R170E/T175R/R233E/E240N | 32.1 | 10.3 | 32% | 7 |
| Y155F/N260S/R318Y/R338E/T343R/R403E/E410N | Y[155]F/N95S/R150Y/R170E/T175R/R233E/E240N | 40.2 | 11.6 | 29% | 5 |
| K228N/K247N/N249S/R318Y/R338E/T343R/R403E/E410N | K63N/K82N/N84S/R150Y/R170E/T175R/R233E/E240N | 25.1 | 5.4 | 21% | 12 |

TABLE 19-continued

Catalytic activity of FIXa variants ($K_M$)

| Mutation (Mature FIX Numbering) | Mutation (Chymotrypsin Numbering) | $K_M$ (nM) | ±S.D. (nM) | % CV | n |
|---|---|---|---|---|---|
| Y155F/K228N/K247N/N249S/R318Y/R338E/T343R/R403E/E410N | Y[155]F/K63N/K82N/N84S/R150Y/R170E/T175R/R233E/E240N | 36.8 | 18.8 | 51% | 5 |
| Y155F/R338E/T343R/R403E | Y[155]F/R170E/T175R/R233E | 28.9 | 9.1 | 31% | 5 |
| R338E/T343R/R403E | R170E/T175R/R233E | 23.5 | 6.5 | 28% | 2 |
| Y155F/R338E/T343R/R403E/E410S | Y[155]F/R170E/T175R/R233E/E240S | 23.9 | 3.1 | 13

Example 5

Determination of the Inhibition of FIXa by the Antithrombin/heparin Complex

Inhibition of wild-type FIXa or FIXa variants by the Antithrombin/heparin complex (AT-III/heparin) was assessed by measuring the level of inhibition by various concentrations of AT-III/heparin on the catalytic activity of FIXa towards a small molecule substrate, Mesyl-D-CHG-Gly-Arg-AMC (Pefafluor FIXa; Pentapharm). A $K_{0.5}$ value is determined for each FIXa variant tested, which corresponds to the molar concentration of AT-III that was required for 50% inhibition ($IC_{50}$) of the catalytic activity of a FIXa variant under the predefined conditions of the assay. Inhibition reactions were performed in the presence of low molecular weight heparin (LMWH; Calbiochem) or full-length unfractionated heparin (UFH; Calbiochem), the latter requiring modified protocol conditions to account for an increase in the rate of inhibition. The apparent second-order rate constant ($k_{app}$) for the inhibition of wild-type FIXa or FIXa variants by the AT-III/UFH complex was also directly evaluated using a modified protocol, in which the time of incubation with the AT-III/UFH complex was varied.

A. Inhibition of FIXa by the Antithrombin/LMWH Complex

For inhibition reactions in the presence of LMWH, a 200 nM solution of AT-III/LMWH (final 2 μM LMWH) was prepared by dilution of a 20 μM stock of plasma purified human AT-III (Molecular Innovations) into a solution of 2 μM LMWH in a 1.2 mL volume of 1× Buffer A (50 mM Tris, 1001nM NaCl, 10 mM $CaCl_2$, 0.01% Tween-20, pH 7.4). This solution of AT-III/LMWH was for use as the highest concentration in the assay. AT-III/LMWH solutions were incubated for at least 30 minutes at room temperature and then serially diluted 1.5-fold in a 96 deep-well polypropylene plate with a final volume of 400 μL 1× Buffer A that contained 2 μM LMWH, resulting in dilutions of 200 nM, 133.3, nM 88.9 nM, 59.3 nM, 39.5 nM, 26.3 nM, 17.6 nM and 0 nM (i.e. rows A-H). A total of 25 μL was aliquoted into their respective rows of a 96-well V-bottom storage plate to fill all columns (i.e. 1-12). FIXa variants were initially diluted to 100 nM in 1× Buffer A. Subsequently, 36 μL of each 100 nM FIXa variant was diluted to a concentration of 1.8 nM in 2.0 mL of 1× Buffer A and then 60 μL of this solution was aliquoted into a 96-well V-bottom storage plate according to a predefined plate map (4 FIXa variants per plate).

Assay reactions were initiated using a BioMek FX liquid handling system programmed to dispense 25 μL. of the FIXa solutions into the plates containing 25 μL of each dilution of AT-III/LMWH per well for a total of two duplicate assay plates for each FIXa variant. The final inhibition assay conditions were: 0.9 nM FIXa and AT-III dilutions ranging from 0 to 100 nM in 1 μM LMWH Inhibition reactions were further incubated for 1 minute at room temperature (~25° C.) before a 25 μL aliquot of the reaction was transferred by the BioMek FX to a 96-well black half-area plate containing 25 μL of 1.6 mM Mesyl-D-CHG-Gly-Arg-AMC per well in assay Buffer B (50 mM Tris, 100 mM NaCl, 10 mM $CaCl_2$, 0.01% Tween-20, pH 7.4, 60% ethylene glycol). Polybrene (hexadimethrine bromide) at a final concentration of 5 mg/mL was added in Buffer B to quench the AT-III/LMWH reaction. Residual activity of FIXa was assessed by following the initial rates of substrate cleavage for 60 minutes in a fluorescence reader set to 25° C. The final assay conditions for determination of residual activity are 0.45 nM FIXa variant, 0.8 mM Mesyl-D-CHG-Gly-Arg-AMC, 30% ethylene glycol and 5 mg/mL polybrene in 50 mM Tris, 100 mM NaCl, 10 mM $CaCl_2$, 0.01% Tween-20, pH 7.4.

To determine the degree of inhibition by AT-III/LMWH for FIXa or FIXa variants, raw data collected with the SoftMax Pro application (Molecular Devices) were exported as .XML files. Further non-linear data analyses were performed with XLfit4, a software package for automated curve fitting and statistical analysis within the Microsoft Excel spreadsheet environment (IDBS Software) or directly within the ActivityBase software package using the XE Runner data analysis module (IDBS Software). The template was used to calculate the AT-III dilution series, ratio of AT-III to FIXa, and the Vi/Vo ratios for each FIXa replicate at each experimental AT-III concentration. The spreadsheet template was used to calculate the AT-III dilution series, ratio of AT-III to FIXa, and the Vi/Vo ratios for each FIXa replicate at each experimental AT-III concentration. Non-linear regression analyses of residual FIXa activity (expressed as Vi/Vo) versus AT-III concentration was processed using XLfit4 and a hyperbolic inhibition equation of the form $((C+(Amp*(1-(X/(K_{0.5}+X))))))$; where C=the offset (fixed at 0 to permit extrapolation of data sets that did not reach 100% inhibition during the course of the assay), Amp=the amplitude of the fit and $K_{0.5}$, which corresponds to the concentration of AT-III required for half-maximal inhibition under the assay conditions. For several FIXa variants, AT-III/LMWH inhibited less than 10-15% of the total protease activity at the highest tested concentration of AT-III, representing an upper limit of detection for the assay under standard screening conditions. Variants with less than 10% maximal inhibition were therefore assigned a lower limit $K_{0.5}$ value of 999 nM and in most cases are expected to have AT-III resistances much greater than the reported value.

Table 20 provides the results of the assays that were performed using AT-III/LMWH. The results are presented both as the fitted $K_{0.5}$ parameter and as a representation of the extent of AT-III resistance for each variant compared to the wild-type FIXa expressed as a ratio of their fitted $K_{0.5}$ values ($K_{0.5}$ variant/$K_{0.5}$ wild-type). Where the $K_{0.5}$ parameter of the FIXa variant was compared to wild-type FIXa, it was compared to a recombinant wild-type FIXa polypeptide that was expressed and purified using the same conditions as used for the variant FIXa polypeptides to ensure that any differences in activity were the result of the mutation(s), and not the result of differences in, for example, post-translational modifications associated with different expression systems. Thus, the wild-type FIXa polypeptide used for comparison was the recombinant wild-type FIXa generated from cloning the FIX gene set forth in SEQ ID NO:1 and expressed from CHOX cells as a polypeptide with an amino acid sequence set forth in SEQ ID NO:3, as described in Example 1 (i.e. Catalyst Biosciences WT FIX polypeptide). Several FIXa variants exhibited greater than 20-fold increased resistance to compared to wild-type FIXa (Catalyst Biosciences WT FIXa). For example, FIXa-R318A/R403A, FIXa-R318E/R340E, FIXa-R318A, FIXa-R318E, FIXa-K400E, FIXa-R338E/R403E and FIXa-K400A/R403A are among the group that exhibited significant resistance to AT-III.

TABLE 20

| Inhibition of FIXa variants by AT-III/LMWH | | | | | | |
|---|---|---|---|---|---|---|
| Mutation (Mature FIX Numbering) | Mutation (Chymotrypsin Numbering) | $K_{0.5}$ (nM) | ±S.D. (nM) | % CV | $K_{0.5\text{-}mut}$/$K_{0.5\text{-}wt}$ | n |
| Plasma Purified FIXa | Plasma Purified FIXa | 20.2 | 6.7 | 33% | 0.7 | 3 |
| BeneFIX (T148A) | BeneFIX (T[148]A) | 27.3 | 4.7 | 17% | 0.9 | 2 |

TABLE 20-continued

Inhibition of FIXa variants by AT-III/LMWH

| Mutation (Mature FIX Numbering) | Mutation (Chymotrypsin Numbering) | $K_{0.5}$ (nM) | ±S.D. (nM) | % CV | $K_{0.5\text{-}mut}/K_{0.5\text{-}wt}$ | n |
|---|---|---|---|---|---|---|
| Catalyst Biosciences WT | Catalyst Biosciences WT | 29.4 | 7.3 | 25% | 1.0 | 10 |
| A103N/N105S | A[103]N/N[105]S | 31.1 | n/a | n/a | 1.1 | 1 |
| D104N/K106S | D[104]N/K[106]S | 26.1 | n/a | n/a | 0.9 | 1 |
| K106N/V108S | K[106]N/V[108]S | 47.7 | n/a | n/a | 1.6 | 1 |
| D85N | D[85]N | 33.1 | n/a | n/a | 1.1 | 1 |
| T148A | T[148]A | 22.9 | 1.7 | 8% | 0.8 | 4 |
| D203N/F205T | D39N/F41T | 154.1 | 50.1 | 33% | 5.2 | 4 |
| I251S | I86S | 22.6 | n/a | n/a | 0.8 | 1 |
| D85N/I251S | D[85]N/I86S | 28.3 | n/a | n/a | 1.0 | 1 |
| D85N/D104N/K106S/I251S | D[85]N/D[104]N/K[106]S/I86S | 32.1 | n/a | n/a | 1.1 | 1 |
| A262S | A95bS | 25.3 | n/a | n/a | 0.9 | 1 |
| K413N | K243N | 34.2 | n/a | n/a | 1.2 | 1 |
| E410N | E240N | 24.8 | 7.8 | 31% | 0.8 | 3 |
| E239N | E74N | 191.8 | 61.0 | 32% | 6.5 | 3 |
| T241N/H243S | T76N/H78S | 35.4 | n/a | n/a | 1.2 | 1 |
| K247N/N249S | K82N/N84S | 23.1 | n/a | n/a | 0.8 | 1 |
| L321N | L153N | 39.0 | n/a | n/a | 1.3 | 1 |
| F314N/H315S | F145N/H147S | 191.8 | 59.8 | 31% | 6.5 | 3 |
| S319N/L321S | S151N/L153S | 113.4 | n/a | n/a | 3.9 | 1 |
| N260S | N95S | 64.6 | n/a | n/a | 2.2 | 1 |
| Y284N | Y117N | 36.7 | n/a | n/a | 1.2 | 1 |
| R318A | R150A | 896.2 | 189.2 | 21% | 30.5 | 2 |
| R318E | R150E | 861.1 | 21.8 | 3% | 29.3 | 2 |
| R318Y | R150Y | 395.1 | 6.3 | 2% | 13.5 | 2 |
| R312Q | R143Q | 52.7 | 5.1 | 10% | 1.8 | 2 |
| R312A | R143A | 51.9 | 1.3 | 3% | 1.8 | 2 |
| R312Y | R143Y | 323.0 | 13.7 | 4% | 11.0 | 2 |
| R312L | R143L | 25.5 | 2.9 | 11% | 0.9 | 2 |
| V202M | V38M | 20.3 | 5.1 | 25% | 0.7 | 2 |
| V202Y | V38Y | 27.2 | 6.9 | 25% | 0.9 | 2 |
| D203M | D39M | 18.6 | 6.9 | 37% | 0.6 | 2 |
| D203Y | D39Y | 31.1 | 0.3 | 1% | 1.1 | 2 |
| A204M | A40M | 45.8 | 11.1 | 24% | 1.6 | 2 |
| A204Y | A40Y | 43.4 | 22.3 | 51% | 1.5 | 2 |
| K400A/R403A | K230A/R233A | 585.0 | 160.5 | 27% | 19.9 | 2 |
| K400E/R403E | K230E/R233E | 299.0 | 206.5 | 69% | 10.2 | 2 |
| R403A | R233A | 164.3 | 88.7 | 54% | 5.6 | 2 |
| R403E | R233E | 264.2 | 80.9 | 31% | 9.0 | 2 |
| K400A | K230A | 384.0 | 121.1 | 32% | 13.1 | 2 |
| K400E | K230E | 614.8 | 71.4 | 12% | 20.9 | 2 |
| K293E | K126E | 290.2 | 42.1 | 15% | 9.9 | 2 |
| K293A | K126A | 194.1 | 38.0 | 20% | 6.6 | 2 |
| R333A | R165A | 225.7 | 72.7 | 32% | 7.7 | 2 |
| R333E | R165E | 345.6 | 1.7 | 0% | 11.8 | 2 |
| R338A | R170A | 56.2 | 8.4 | 15% | 1.9 | 2 |
| R338E | R170E | 238.4 | n/a | n/a | 8.1 | 1 |
| R338A/R403A | R170A/R233A | 418.5 | 150.9 | 36% | 14.2 | 2 |
| R338E/R403E | R170E/R233E | 601.6 | 241.5 | 40% | 20.5 | 2 |
| K293A/R403A | K126A/R233A | 486.3 | 114.9 | 24% | 16.6 | 2 |
| K293E/R403E | K126E/R233E | 342.0 | 4.9 | 1% | 11.6 | 2 |
| K293A/R338A/R403A | K126A/R170A/R233A | 497.1 | 85.9 | 17% | 16.9 | 2 |
| K293E/R338E/R403E | K126E/R170E/R233E | 418.5 | 150.9 | 36% | 14.2 | 2 |
| R318A/R403A | R150A/R233A | 999.0 | n/a | n/a | 34.0 | 2 |
| R318E/R403E | R150E/R233E | 999.0 | n/a | n/a | 34.0 | 2 |

A $K_{0.5}$ value of 999 nM indicates the lower limit value for those variants with less than 10% inhibition under the conditions of the assay.

B. Inhibition of FIXa by the Antithrombin/UFH Complex

Additional experiments were performed to assess the inhibition of FIXa variants by AT-III/UFH (unfractionated full-length heparin) using the same assay as described above with minor modifications. Full-length, unfractionated heparin (Calbiochem) was used instead of low molecular weight heparin (LMWH) to observe the effects of FIXa variant mutations on the increased rate of the inhibition reaction due to the "templating" effect provided by longer heparin chains (see e.g., Olson et al. (2004) Thromb Haemost 92(5), 929-939).

For inhibition reactions in the presence of UFH, a 70 nM, 600 nM, 2000 nM, 6000 or 10000 nM solutions of AT-III/UFH (final 1 µM UFH) were prepared by dilution of a 20 µM stock of plasma purified human AT-III (Molecular Innovations) into a solution of excess UFH (2 to 20 µM) in a 1.4 mL volume of 1× Buffer A (50 mM Tris, 100 mM NaCl, 10 mM $CaCl_2$, 0.01% Tween-20, pH 7.4). AT-III/UFH solutions were also incubated for 30 minutes at room temperature before being serially diluted 1.5-fold in a 96 deep-well polypropylene plate with a final volume of 460 µL 1× Buffer A containing 1 µM UFH. The final dilutions of AT-III for the modified assay were dependent on the starting concentration of AT-III and ranged from 70 nM-0 nM, 600 nM-0 nM, 100 nM-0 nM or 5000 nM-0 nM (i.e. rows A-H). Those variants, which showed increased resistance to AT-III inhibition under the standard conditions, were further tested using higher concentrations of AT-III. A total of 35 µL of each AT-III dilution was aliquoted into their respective rows of a 96-well V-bottom storage plate to fill all columns (i.e. 1-12). FIXa variants were initially diluted to 100 nM in 1× Buffer A. Subsequently, 15 μL of each 100 nM FIXa variant was diluted to a concentration of 0.6 nM in 2.0 mL of 1× Buffer A and then 70 μL of this solution was aliquoted into a 96-well V-bottom storage plate according to the same predefined plate map (4 FIXa variants per plate).

Assay reactions were initiated using a BioMek FX liquid handling system programmed to dispense 35 μL of the FIXa solutions into the plates containing 35 μL of each dilution of AT-III/heparin per well for a total of two duplicate assay plates for each FIXa variant. The final inhibition assay conditions were: 0.3 nM FIXa and AT-III dilutions ranging from 35 nM to 0 nM, 300 nM to 0 nM, 1000 nM to 0 nM, 3000 nM to 0 nM or 5000 nM to 0 nM in UFH ranging from 1 μM to 10 μM, depending of the highest AT-III concentration so that the heparin remained in excess Inhibition reactions were further incubated for 10 seconds at room temperature (~25° C.) before a 40 μL aliquot of the reaction was transferred by the BioMek FX to a 96-well black half-area plate containing 20 μL of 2.5 mM Mesyl-D-CHG-Gly-Arg-AMC per well in assay Buffer C (50 mM Tris, 100 mM NaCl, 10 mM CaCl$_2$, 0.01% Tween-20, pH 7.4, 82% ethylene glycol and 5 mg/mL polybrene). Polybrene (hexadimethrine bromide) at a final concentration of 5 mg/mL was added to Buffer C to quench the AT-III/UFH reaction. Residual activity of FIXa was assessed by following the initial rates of substrate cleavage for 60 minutes in a fluorescence reader set to 25° C. The final assay conditions for determination of residual activity were 0.2 nM FIXa variant, 0.83 mM Mesyl-D-CHG-Gly-Arg-AMC, 30% ethylene glycol and 5 mg/mL polybrene in 50 mM Tris, 100 mM NaCl, 10 mM CaCl$_2$, 0.01% Tween-20, pH 7.4. Data analyses were performed as described above for AT-III/LMWH inhibition assays.

As found with LMWH, AT-III/UFH inhibited less than 10-15% of the of the total protease activity for a number of FIXa variants at the highest tested concentrations of AT-III, thus representing an upper limit of detection for the assay under standard screening conditions. These variants with less than 10% maximal inhibition were therefore assigned a lower limit $K_{0.5}$ value of 999 nM and in most cases are expected to have AT-III resistances much greater than the reported value. Several FIXa variants that were initially given a $K_{0.5}$ value of 999 nM were retested at higher AT-III concentrations, expanding the sensitivity of the assay and providing clear levels of AT-III resistance. If these variants still maintained less than 10% maximal inhibition at the highest test AT-III concentrations (1000 nM to 5000 nM) a lower limit $K_{0.5}$ value of 9999 nM was assigned, thus these variants are expected to have AT-III resistances much greater than the reported value.

Tables 21-22 provide the results of the assays that were performed using AT-III/UFH. Table 22 reflects data for additional FIXa variants and provide new overall averages calculated to include additional experimental replicates (n) for FIXa variants in Table 21. The results are presented both as the fitted $K_{0.5}$ parameter and as a representation of the extent of AT-III resistance for each variant compared to the wild-type FIXa expressed as a ratio of their fitted $K_{0.5}$ values ($K_{0.5}$ variant/$K_{0.5}$ wild-type). Several FIXa variants exhibited greater than 100 to 500-fold increased resistance to AT-III compared to wild-type FIXa. For example, FIXa-R318A/R403A, FIXa-R318A, FIXa-R318Y, FIXa-R338A/R403A FIXa-D203N/F205T/R318Y, FIXa-R318Y/R338E/R403E, FIXa-R318Y/R338E/R403E, FIXa-R318Y/R338E/E410N, R318Y/R338E/T343R/N346Y/R403E/E410N and FIXa-R318Y/R403E/E410N are among this group, which exhibited significant resistance to AT-III.

TABLE 21

Inhibition of FIXa variants by AT-III/UFH

| Mutation (Mature FIX Numbering) | Mutation (Chymotrypsin Numbering) | $K_{0.5}$ (nM) | ±S.D. (nM) | % CV | $K_{0.5-mut}$/ $K_{0.5-wt}$ | n |
|---|---|---|---|---|---|---|
| BeneFIX Benefix ® Coagulation FIX (T148A) | BeneFIX Benefix ® Coagulation FIX (T[148]A) | 18 | 8 | 44% | 0.9 | 51 |
| Plasma Purified FIXa | Plasma Purified FIXa | 30 | 4 | 14% | 1.6 | 5 |
| Catalyst Biosciences WT | Catalyst Biosciences WT | 19 | 7 | 34% | 1.0 | 15 |
| N157D | N[157]D | 17 | 4 | 23% | 0.9 | 2 |
| Y155F | Y[155]F | 13 | 0 | 1% | 0.7 | 2 |
| A103N/N105S/Y155F | A[103]N/N[105]S/Y[155]F | 11 | 6 | 49% | 0.6 | 2 |
| D104N/K106S/Y155F | D[104]N/K[106]S/Y[155]F | 6 | 2 | 33% | 0.3 | 2 |
| A103N/N105S | A[103]N/N[105]S | 20 | 3 | 14% | 1.0 | 2 |
| D104N/K106S | D[104]N/K[106]S | 20 | 2 | 9% | 1.0 | 2 |
| K106N/V108S | K[106]N/V[108]S | 24 | 0 | 1% | 1.2 | 2 |
| D85N | D[85]N | 17 | 3 | 15% | 0.9 | 4 |
| T148A | T[148]A | 21 | 8 | 39% | 1.1 | 10 |
| K5A | K[5]A | 22 | 3 | 15% | 1.2 | 2 |
| D64N | D[64]N | 18 | 0 | 1% | 0.9 | 2 |
| D64A | D[64]A | 16 | 2 | 12% | 0.8 | 2 |
| N167D | N[167]D | 12 | 2 | 14% | 0.6 | 2 |
| N167Q | N[167]Q | 12 | 1 | 8% | 0.6 | 2 |
| S61A | S[61]A | 19 | 3 | 18% | 1.0 | 2 |
| S53A | S[53]A | 27 | 4 | 16% | 1.4 | 2 |
| T159A | T[159]A | 33 | 7 | 23% | 1.7 | 2 |
| T169A | T[169]A | 17 | 6 | 36% | 0.9 | 2 |
| T172A | T[172]A | 16 | 3 | 21% | 0.8 | 2 |
| T179A | T[179]A | 24 | 2 | 7% | 1.2 | 2 |
| Y155H | Y[155]H | 25 | 4 | 15% | 1.3 | 2 |
| Y155Q | Y[155]Q | 23 | 0 | 1% | 1.2 | 2 |
| S158A | S[158]A | 20 | 1 | 5% | 1.0 | 2 |
| S158D | S[158]D | 15 | 2 | 16% | 0.8 | 2 |
| S158E | S[158]E | 14 | 1 | 10% | 0.7 | 2 |
| N157Q | N[157]Q | 16 | 2 | 11% | 0.8 | 2 |
| D203N/F205T | D39N/F41T | 271 | 51 | 19% | 14.0 | 5 |
| D85N/D203N/F205T | D[85]N/D39N/F41T | 587 | 65 | 11% | 30.3 | 2 |

TABLE 21-continued Inhibition of FIXa variants by AT-III/UFH

| Mutation (Mature FIX Numbering) | Mutation (Chymotrypsin Numbering) | $K_{0.5}$ (nM) | ±S.D. (nM) | % CV | $K_{0.5-mut}$/ $K_{0.5-wt}$ | n |
|---|---|---|---|---|---|---|
| K228N | K63N | 29 | 13 | 46% | 1.5 | 6 |
| D85N/K228N | D[85]N/K63N | 34 | 3 | 7% | 1.7 | 2 |
| A103N/N105S/K228N | A[103]N/N[105]S/K63N | 46 | 17 | 36% | 2.4 | 2 |
| D104N/K106S/K228N | D[104]N/K[106]S/K63N | 41 | 21 | 52% | 2.1 | 2 |
| Y155F/K228N | Y[155]F/K63N | 15 | n.d. | n.d. | 0.8 | 1 |
| D104N/K106S/Y155F/K228N | D[104]N/K[106]S/Y[155]F/K63N | 49 | 5 | 9% | 2.5 | 2 |
| I251S | I86S | 28 | 8 | 28% | 1.4 | 4 |
| D85N/I251S | D[85]N/I86S | 19 | 6 | 30% | 1.0 | 2 |
| D85N/D104N/K106S/I251S | D[85]N/D[104]N/K[106]S/I86S | 28 | 11 | 41% | 1.4 | 2 |
| A103N/N105S/I251S | A[103]N/N[105]S/I86S | 42 | 14 | 33% | 2.2 | 3 |
| D104N/K106S/I251S | D[104]N/K[106]S/I86S | 32 | 5 | 16% | 1.6 | 2 |
| Y155F/I251S | Y[155]F/I86S | 18 | 3 | 19% | 0.9 | 2 |
| A262S | A95bS | 25 | 5 | 21% | 1.3 | 2 |
| K413N | K243N | 27 | 13 | 48% | 1.4 | 2 |
| E410N | E240N | 9 | 2 | 27% | 0.5 | 4 |
| E239N | E74N | 132 | 21 | 16% | 6.8 | 2 |
| T241N/H243S | T76N/H78S | 21 | 12 | 56% | 1.1 | 2 |
| K247N/N249S | K82N/N84S | 22 | 4 | 18% | 1.1 | 4 |
| Y155F/K247N/N249S | Y[155]F/K82N/N84S | 13 | 3 | 24% | 0.7 | 4 |
| A103N/N105S/K247N/N249S | A[103]N/N[105]S/K82N/N84S | 53 | 29 | 55% | 2.7 | 4 |
| D104N/K106S/K247N/N249S | D[104]N/K[106]S/K82N/N84S | 19 | 2 | 9% | 1.0 | 2 |
| D104N/K106S/Y155F/K247N/ N249S | D[104]N/K[106]S/Y[155]F/K82N/ N84S | 27 | 2 | 9% | 1.4 | 2 |
| L321N | L153N | 25 | 6 | 25% | 1.3 | 2 |
| F314N/H315S | F145N/H147S | 104 | 27 | 26% | 5.4 | 4 |
| S319N/L321S | S151N/L153S | 65 | 11 | 17% | 3.4 | 2 |
| N260S | N95S | 312 | 283 | 91% | 16.1 | 13 |
| D104N/K106S/N260S | D[104]N/K[106]S/N95S | 228 | 82 | 36% | 11.8 | 2 |
| Y155F/N260S | Y[155]F/N95S | 77 | 16 | 21% | 4.0 | 2 |
| D104N/K106S/Y155F/N260S | D[104]N/K[106]S/Y[155]F/N95S | 292 | 37 | 13% | 15.1 | 2 |
| Y284N | Y117N | 41 | 25 | 63% | 2.1 | 5 |
| R318N/A320S | R150N/A152S | 999 | 0 | 0% | 51.7 | 2 |
| R318A | R150A | 4145 | 1297 | 31% | 214.3 | 2 |
| R318E | R150E | 10000 | 0 | 0% | 517.0 | 2 |
| R318Y | R150Y | 1976 | 430 | 22% | 102.2 | 2 |
| R312Q | R143Q | 33 | 9 | 26% | 1.7 | 2 |
| R312A | R143A | 31 | 0 | 1% | 1.6 | 2 |
| R312Y | R143Y | 2499 | 350 | 14% | 129.2 | 2 |
| R312L | R143L | 17 | 1 | 5% | 0.9 | 2 |
| V202M | V38M | 14 | 2 | 14% | 0.7 | 2 |
| V202Y | V38Y | 18 | 3 | 14% | 0.9 | 2 |
| D203M | D39M | 11 | 0 | 1% | 0.6 | 2 |
| D203Y | D39Y | 16 | 3 | 21% | 0.8 | 2 |
| A204M | A40M | 29 | 3 | 9% | 1.5 | 2 |
| A204Y | A40Y | 24 | 1 | 3% | 1.2 | 2 |
| K400A/R403A | K230A/R233A | 999 | 0 | 0% | 51.7 | 2 |
| K400E/R403E | K230E/R233E | 999 | 0 | 0% | 51.7 | 2 |
| R403A | R233A | 190 | 34 | 18% | 9.8 | 4 |
| R403E | R233E | 731 | 14 | 2% | 37.8 | 2 |
| K400A | K230A | 114 | 3 | 3% | 5.9 | 2 |
| K400E | K230E | 301 | 27 | 9% | 15.6 | 2 |
| K293E | K126E | 187 | 25 | 13% | 9.7 | 2 |
| K293A | K126A | 82 | 1 | 1% | 4.2 | 2 |
| R333A | R165A | 235 | 54 | 23% | 12.1 | 2 |
| R333E | R165E | 999 | 0 | 0% | 51.7 | 2 |
| R338A | R170A | 33 | 3 | 10% | 1.7 | 2 |
| R338E | R170E | 222 | 124 | 56% | 11.5 | 8 |
| R338A/R403A | R170A/R233A | 328 | 106 | 32% | 17.0 | 6 |
| R338E/R403E | R170E/R233E | 6000 | 1089 | 18% | 310.2 | 2 |
| K293A/R403A | K126A/R233A | 999 | 0 | 0% | 51.7 | 2 |
| K293E/R403E | K126E/R233E | 999 | 0 | 0% | 51.7 | 2 |
| K293A/R338A/R403A | K126A/R170A/R233A | 999 | 0 | 0% | 51.7 | 2 |
| K293E/R338E/R403E | K126E/R170E/R233E | 999 | 0 | 0% | 51.7 | 2 |
| R318A/R403A | R150A/R233A | 999 | 0 | 0% | 51.7 | 2 |
| R318E/R403E | R150E/R233E | 999 | 0 | 0% | 51.7 | 2 |
| R318Y/E410N | R150Y/E240N | 607 | 164 | 27% | 31.4 | 4 |
| R338E/E410N | R170E/E240N | 92 | 14 | 15% | 4.7 | 4 |
| R338E/R403E/E410N | R170E/R233E/E240N | 2351 | 168 | 7% | 121.5 | 2 |
| R318Y/R338E/R403E | R150Y/R170E/R233E | 10000 | 0 | 0% | 517.0 | 7 |
| D203N/F205T/K228N | D39N/F41T/K63N | 822 | 69 | 8% | 42.5 | 2 |
| D203N/F205T/E410N | D39N/F41T/E240N | 377 | 20 | 5% | 19.5 | 2 |
| D203N/F205T/R338E | D39N/F41T/R170E | 1170 | 180 | 15% | 60.5 | 2 |
| D203N/F205T/R338A | D39N/F41T/R170A | 423 | 61 | 14% | 21.9 | 2 |
| D203N/F205T/R318Y | D39N/F41T/R150Y | 7226 | 133 | 2% | 373.6 | 2 |
| D203N/F205T/R338E/R403E | D39N/F41T/R170E/R233E | 1520 | 162 | 11% | 78.6 | 2 |

TABLE 21-continued

Inhibition of FIXa variants by AT-III/UFH

| Mutation (Mature FIX Numbering) | Mutation (Chymotrypsin Numbering) | $K_{0.5}$ (nM) | ±S.D. (nM) | % CV | $K_{0.5\text{-}mu}/K_{0.5\text{-}wt}$ | n |
|---|---|---|---|---|---|---|
| K228N/E410N | K63N/E240N | 36 | 7 | 20% | 1.9 | 2 |
| K228N/R338E | K63N/R170E | 108 | 8 | 7% | 5.6 | 2 |
| K228N/R338A | K63N/R170A | 51 | 7 | 14% | 2.7 | 2 |
| K228N/R318Y | K63N/R150Y | 3414 | 73 | 2% | 176.5 | 2 |
| K228N/R338E/R403E | K63N/R170E/R233E | 1679 | 239 | 14% | 86.8 | 2 |
| R403E/E410N | R233E/E240N | 279 | 26 | 9% | 14.4 | 2 |
| R318Y/R338E/E410N | R150Y/R170E/E240N | 3458 | 1033 | 30% | 178.8 | 5 |
| D104N/K106S/R318Y/R338E/E410N | D[104]N/K[106]S/R150Y/R170E/E240N | 6328 | 4241 | 67% | 327.2 | 4 |
| Y155F/R318Y/R338E/E410N | Y[155]F/R150Y/R170E/E240N | 1098 | 1095 | 100% | 56.8 | 7 |
| K228N/R318Y/E410N | K63N/R150Y/E240N | 475 | 83 | 17% | 24.6 | 2 |
| R318Y/R403E/E410N | R150Y/R233E/E240N | 7072 | 1387 | 20% | 365.6 | 2 |
| R318Y/R338E/R403E/E410N | R150Y/R170E/R233E/E240N | 5881 | 4757 | 81% | 304.1 | 4 |
| A103N/N105S/R318Y/R338E/R403E/E410N | A[103]N/N[105]S/R150Y/R170E/R233E/E240N | 9193 | 1

TABLE 21-continued

Inhibition of FIXa variants by AT-III/UFH

| Mutation (Mature FIX Numbering) | Mutation (Chymotrypsin Numbering) | $K_{0.5}$ (nM) | ±S.D. (nM) | % CV | $K_{0.5\text{-}mut}/K_{0.5\text{-}wt}$ | n |
|---|---|---|---|---|---|---|
| F314N/K316S | F145N/K148S | 1221 | 505 | 41% | 63.1 | 4 |
| K247N/N249S/R318Y/R338E/R403E/E410N | K82N/N84S/R150Y/R170E/R233E/E240N | 8076 | 2967 | 37% | 417.6 | 9 |
| Y155F/K247N/N249S/R318Y/R338E/R403E/E410N | Y[155]F/K82N/N84S/R150Y/R170E/R233E/E240N | 10000 | 0 | 0% | 517.0 | 3 |
| A103N/N105S/K247N/N249S/R318Y/R338E/R403E/E410N | A[103]N/N[105]S/K82N/N84S/R150Y/R170E/R233E/E240N | 2497 | 772 | 31% | 129.1 | 4 |
| D104N/K106S/K247N/N249S/R318Y/R338E/R403E/E410N | D[104]N/K[106]S/K82N/N84S/R150Y/R170E/R233E/E240N | 10000 | 0 | 0% | 517.0 | 2 |
| K247N/N249S/R318Y/R338E/E410N | K82N/N84S/R150Y/R170E/E240N | 1514 | 631 | 42% | 78.3 | 3 |
| Y155F/K247N/N249S/R318Y/R338E/E410N | Y[155]F/K82N/N84S/R150Y/R170E/E240N | 3875 | 846 | 22% | 200.4 | 2 |
| R318Y/R338E/R403E/E410S | R150Y/R170E/R233E/E240S | 10000 | 0 | 0% | 517.0 | 2 |
| R318Y/R338E/E410S | R150Y/R170E/E240S | 5402 | 2785 | 52% | 279.3 | 5 |
| K228N/K247N/N249S | K63N/K82N/N84S | 85 | 19 | 22% | 4.4 | 2 |
| D104N/K106S/Y155F/K228N/K247N/N249S | D[104]N/K[106]S/Y[155]F/K63N/K82N/N84S | 32 | 12 | 37% | 1.6 | 4 |
| D104N/K106S/K228N/K247N/N249S | D[104]N/K[106]S/K63N/K82N/N84S | 41 | 18 | 45% | 2.1 | 10 |
| Y155F/K228N/K247N/N249S | Y[155]F/K63N/K82N/N84S | 27 | 6 | 22% | 1.4 | 2 |
| K228N/K247N/N249S/R318Y R338E/R403E/E410N | K63N/K82N/N84S/R150Y/R170E/R233E/E240N | 10000 | 0 | 0% | 517.0 | 2 |
| R318Y/R338E/R403E/E410N/T412V | R150Y/R170E/R233E/E240N/T242V | 10000 | 0 | 0% | 517.0 | 2 |
| R318Y/R338E/R403E/E410N/T412A | R150Y/R170E/R233E/E240N/T242A | 10000 | 0 | 0% | 517.0 | 2 |
| R318Y/R338E/R403E/T412A | R150Y/R170E/R233E/T242A | 10000 | 0 | 0% | 517.0 | 2 |
| R318Y/R338E/T412A | R150Y/R170E/T242A | 7661 | 3243 | 42% | 396.1 | 9 |
| R318Y/R338E/E410N/T412V | R150Y/R170E/E240N/T242V | 10000 | 0 | 0% | 517.0 | 2 |
| N260S/R318Y/R338E/R403E/E410N | N95S/R150Y/R170E/R233E/E240N | 10000 | 0 | 0% | 517.0 | 2 |
| D104N/K106S/N260S/R318Y/R338E/R403E/E410N | D[104]N/K[106]S/N95S/R150Y/R170E/R233E/E240N | 10000 | 0 | 0% | 517.0 | 3 |
| Y155F/N260S/R318Y/R338E/R403E/E410N | Y[155]F/N95S/R150Y/R170E/R233E/E240N | 9696 | 527 | 5% | 501.3 | 3 |
| R318Y/R338E/N346D/R403E/E410N | R150Y/R170E/N178D/R233E/E240N | 10000 | 0 | 0% | 517.0 | 2 |
| Y155F/R318Y/R338E/N346D/R403E/E410N | Y[155]F/R150Y/R170E/N178D/R233E/E240N | 10000 | 0 | 0% | 517.0 | 2 |
| K247N/N249S/N260S | K82N/N84S/N95S | 157 | 38 | 24% | 8.1 | 3 |
| Y155F/K247N/N249S/N260S | Y[155]F/K82N/N84S/N95S | 152 | 39 | 26% | 7.9 | 3 |
| D[104]N/K[106]S/K247N/N249S N260S | D[104]N/K[106]S/K82N/N84S/N95S | 1262 | 40 | 3% | 65.3 | 2 |
| D[104]N/K[106]S/Y[155]F/K247N/N249S/N260S | D[104]N/K[106]S/Y[155]F/K82N/N84S/N95S | 692 | 84 | 12% | 35.8 | 2 |
| K247N/N249S/N260S/R318Y/R338E/R403E/E410N | K82N/N84S/N95S/R150Y/R170E/R233E/E240N | 5560 | 3872 | 70% | 287.5 | 3 |
| Y155F/N260S/N346D | Y[155]F/N95S/N178D | 1382 | 477 | 35% | 71.4 | 2 |
| R318Y/R338E/T343R/R403E/E410N | R150Y/R170E/T175R/R233E/E240N | 10000 | 0 | 0% | 517.0 | 2 |
| R338E/T343R | R170E/T175R | 16 | 6 | 38% | 0.8 | 2 |

A $K_{0.5}$ value of 999 nM indicates the lower limit value for those variants with less than 10% inhibition under the conditions of the standard assay (35 nM-0 nM AT-III).
Variants with >50% of WT $k_{cat}/K_M$ (see Example 4, Table 14) and initially given a $K_{0.5}$ value of 999 nM were retested at higher AT-III concentrations, expanding in the sensitivity of the assay.
A $K_{0.5}$ value of 9999 nM indicates the lower limit value for those variants with less than 10% inhibition under the conditions of the expanded sensitivity assay (1000 nM-0 nM AT-III and 5000-0 nM AT-III).

TABLE 22

Inhibition of FIXa variants by AT-III/UFH

| Mutation (Mature FIX Numbering) | Mutation (Chymotrypsin Numbering) | $K_{0.5}$ (nM) | ±S.D. (nM) | % CV | $K_{0.5\text{-}mut}/K_{0.5\text{-}wt}$ | n |
|---|---|---|---|---|---|---|
| BeneFIX Benefix ® Coagulation FIX (T148A) | BeneFIX Benefix ® Coagulation FIX (T[148]A) | 17 | 8 | 47% | 0.9 | 55 |
| Plasma Purified FIXa | Plasma Purified FIXa | 30 | 4 | 14% | 1.6 | 5 |
| Catalyst Biosciences WT | Catalyst Biosciences WT | 19 | 7 | 34% | 1.0 | 15 |
| N157D | N[157]D | 17 | 4 | 23% | 0.9 | 2 |
| Y155F | Y[155]F | 13 | 0 | 1% | 0.7 | 2 |
| A103N/N105S/Y155F | A[103]N/N[105]S/Y[155]F | 11 | 6 | 49% | 0.6 | 2 |
| D104N/K106S/Y155F | D[104]N/K[106]S/Y[155]F | 6 | 2 | 33% | 0.3 | 2 |

TABLE 22-continued

Inhibition of FIXa variants by AT-III/UFH

| Mutation (Mature FIX Numbering) | Mutation (Chymotrypsin Numbering) | $K_{0.5}$ (nM) | ±S.D. (nM) | % CV | $K_{0.5\text{-}mut}/K_{0.5\text{-}wt}$ | n |
|---|---|---|---|---|---|---|
| A103N/N105S | A[103]N/N[105]S | 20 | 3 | 14% | 1.0 | 2 |
| D104N/K106S | D[104]N/K[106]S | 20 | 2 | 9% | 1.0 | 2 |
| K106N/V108S | K[106]N/V[108]S | 24 | 0 | 1% | 1.2 | 2 |
| D85N | D[85]N | 17 | 3 | 15% | 0.9 | 4 |
| T148A | T[148]A | 17 | 10 | 56% | 0

TABLE 22-continued

Inhibition of FIXa variants by AT-III/UFH

| Mutation (Mature FIX Numbering) | Mutation (Chymotrypsin Numbering) | $K_{0.5}$ (nM) | ±S.D. (nM) | % CV | $K_{0.5\text{-}mut}/K_{0.5\text{-}wt}$ | n |
|---|---|---|---|---|---|---|
| K293E | K126E | 187 | 25 | 13% | 9.7 | 2 |
| K293A | K126A | 82 | 1 | 1% | 4.2 | 2 |
| R333A | R165A | 235 | 54 | 23% | 12.1 | 2 |
| R333E | R165E | 999 | 0 | 0% | 51.7 | 2 |
| R338A | R170A | 33 | 3 | 10% | 1.7 | 2 |
| R338E | R170E | 222 | 124 | 56% | 11.5 | 8 |
| R338A/R403A | R170A/R233A | 328 | 106 | 32% | 17.0 | 6 |
| R338E/R403E | R170E/R233E | 6000 | 1089 | 18

TABLE 22-continued

Inhibition of FIXa variants by AT-III/UFH

| Mutation (Mature FIX Numbering) | Mutation (Chymotrypsin Numbering) | $K_{0.5}$ (nM) | ±S.D. (nM) | % CV | $K_{0.5\text{-}mut}/K_{0.5\text{-}wt}$ | n |
|---|---|---|---|---|---|---|
| Y345T | Y177T | 16 | 0 | 0% | 0.8 | 2 |
| T343R | T175R | 7 | 1 | 10% | 0.4 | 2 |
| T343E | T175E | 55 | 8 | 15% | 2.8 | 2 |
| T343Q | T175Q | 13 | 3 | 25% | 0.7 | 2 |
| F342I | F174I | 98 | 10 | 11% | 5.1 | 2 |
| T343R/Y345T | T175R/Y177T | 6 | 0 | 4% | 0.3 | 2 |
| R318Y/R338E | R150Y/R170E | 397 | 50 | 12% | 20.5 | 2 |
| Y259F/K265T/Y345T | Y94F/K98T/Y177T | 6 | 0 | 2% | 0.3 | 2 |
| K228N/I251S | K63N/I86S | 73 | 16 | 22% | 3.8 | 2 |
| K228N/R318Y/R338E/R403E/E410N | K63N/R150Y/R170E/R233E/E240N | 10000 | 0 | 0% | 517.0 | 2 |
| Y155F/K228N/R318Y/R338E/R403E/E410N | Y[155]F/K63N/R150Y/R170E/R233E/E240N | 10000 | 0 | 0% | 517.0 | 2 |
| D85N/K228N/R318Y/R338E/R403E/E410N | D[85]N/K63N/R150Y/R170E/R233E/E240N | 10000 | 0 | 0% | 517.0 | 2 |
| I251S/R318Y/R338E/R403E/E410N | I86S/R150Y/R170E/R233E/E240N | 10000 | 0 | 0% | 517.0 | 2 |
| D104N/K106S/I251S/R318Y/R338E/R403E/E410N | D[104]N/K[106]S/I86S/R150Y/R170E/R233E/E240N | 10000 | 0 | 0% | 517.0 | 3 |
| Y155F/I251S/R318Y/R338E/R403E/E410N | D[104]N/K[106]S/I86S/R150Y/R170E/R233E/E240N | 10000 | 0 | 0% | 517.0 | 2 |
| I251S/R318Y/R338E/E410N | I86S/R150Y/R170E/E240N | 5855 | 3889 | 66% | 302.7 | 7 |
| D104N/K106S/I251S/R318Y/R338E/E410N | D[104]N/K[106]S/I86S/R150Y/R170E/E240N | 8985 | 1436 | 16% | 464.5 | 2 |
| F314K/K316S | F145N/K148S | 1221 | 505 | 41% | 63.1 | 4 |
| K247N/N249S/R318Y/R338E/R403E/E410N | K82N/N84S/R150Y/R170E/R233E/E240N | 8076 | 2967 | 37% | 417.6 | 9 |
| Y155F/K247N/N249S/R318Y/R338E/R403E/E410N | Y[155]F/K82N/N84S/R150Y/R170E/R233E/E240N | 10000 | 0 | 0% | 517.0 | 3 |
| A103N/N105S/K247N/N249S/R318Y/R338E/R403E/E410N | A[103]N/N[105]S/K82N/N84S/R150Y/R170E/R233E/E240N | 2497 | 772 | 31% | 129.1 | 4 |
| D104N/K106S/K247N/N249S/R318Y/R338E/R403E/E410N | D[104]N/K[106]S/K82N/N84S/R150Y/R170E/R233E/E240N | 10000 | 0 | 0% | 517.0 | 2 |
| K247N/N249S/R318Y/R338E/E410N | K82N/N84S/R150Y/R170E/E240N | 1514 | 631 | 42% | 78.3 | 3 |
| Y155F/K247N/N249S/R318Y/R338E/E410N | Y[155]F/K82N/N84S/R150Y/R170E/E240N | 3875 | 846 | 22% | 200.4 | 2 |
| R318Y/R338E/R403E/E410S | R150Y/R170E/R233E/E240S | 10000 | 0 | 0% | 517.0 | 2 |
| R318Y/R338E/E410S | R150Y/R170E/E240S | 5402 | 2785 | 52% | 279.3 | 5 |
| K228N/K247N/N249S | K63N/K82N/N84S | 85 | 19 | 22% | 4.4 | 2 |
| D104N/K106S/Y155F/K228N/K247N/N249S | D[104]N/K[106]S/Y[155]F/K63N/K82N/N84S | 32 | 12 | 37% | 1.6 | 4 |
| D104N/K106S/K228N/K247N/N249S | D[104]N/K[106]S/K63N/K82N/N84S | 41 | 18 | 45% | 2.1 | 10 |
| Y155F/K228N/K247N/N249S | Y[155]F/K63N/K82N/N84S | 27 | 6 | 22% | 1.4 | 2 |
| K228N/K247N/N249S/R318Y/R338E/R403E/E410N | K63N/K82N/N84S/R150Y/R170E/R233E/E240N | 10000 | 0 | 0% | 517.0 | 2 |
| R318Y/R338E/R403E/E410N/T412V | R150Y/R170E/R233E/E240N/T242V | 10000 | 0 | 0% | 517.0 | 2 |
| R318Y/R338E/R403E/E410N/T412A | R150Y/R170E/R233E/E240N/T242A | 10000 | 0 | 0% | 517.0 | 2 |
| R318Y/R338E/R403E/T412A | R150Y/R170E/R233E/T242A | 10000 | 0 | 0% | 517.0 | 2 |
| R318Y/R338E/T412A | R150Y/R170E/T242A | 7661 | 3243 | 42% | 396.1 | 9 |
| R318Y/R338E/E410N/T412V | R150Y/R170E/E240N/T242V | 4871 | 4173 | 86% | 251.8 | 9 |
| N260S/R318Y/R338E/R403E/E410N | N95S/R150Y/R170E/R233E/E240N | 10000 | 0 | 0% | 517.0 | 2 |
| D104N/K106S/N260S/R318Y/R338E/R403E/E410N | D[104]N/K[106]S/N95S/R150Y/R170E/R233E/E240N | 10000 | 0 | 0% | 517.0 | 3 |
| Y155F/N260S/R318Y/R338E/R403E/E410N | Y[155]F/N95S/R150Y/R170E/R233E/E240N | 9696 | 527 | 5% | 501.3 | 3 |
| R318Y/R338E/N346D/R403E/E410N | R150Y/R170E/N178D/R233E/E240N | 10000 | 0 | 0% | 517.0 | 2 |
| Y155F/R318Y/R338E/N346D/R403E/E410N | Y[155]F/R150Y/R170E/N178D/R233E/E240N | 10000 | 0 | 0% | 517.0 | 2 |
| K247N/N249S/N260S | K82N/N84S/N95S | 157 | 38 | 24% | 8.1 | 3 |
| Y155F/K247N/N249S/N260S | Y[155]F/K82N/N84S/N95S | 152 | 39 | 26% | 7.9 | 3 |
| D104N/K106S/K247N/N249S/N260S | D[104]N/K[106]S/K82N/N84S/N95S | 1262 | 40 | 3% | 65.3 | 2 |
| D104N/K106S/Y155F/K247N/N249S/N260S | D[104]N/K[106]S/Y[155]F/K82N/N84S/N95S | 692 | 84 | 12% | 35.8 | 2 |
| K247N/N249S/N260S/R318Y/R338E/R403E/E410N | K82N/N84S/N95S/R150Y/R170E/R233E/E240N | 5560 | 3872 | 70% | 287.5 | 3 |
| Y155F/N260S/N346D | Y[155]F/N95S/N178D | 1382 | 477 | 35% | 71.4 | 2 |
| R318Y/R338E/T343R/R403E/E410N | R150Y/R170E/T175R/R233E/E240N | 10000 | 0 | 0% | 517.0 | 4 |

TABLE 22-continued

Inhibition of FIXa variants by AT-III/UFH

| Mutation (Mature FIX Numbering) | Mutation (Chymotrypsin Numbering) | $K_{0.5}$ (nM) | ±S.D. (nM) | % CV | $K_{0.5\text{-}mut}/K_{0.5\text{-}wt}$ | n |
|---|---|---|---|---|---|---|
| R338E/T343R | R170E/T175R | 12 | 6 | 46% | 0.6 | 4 |
| T343R/N346Y | T175R/N178Y | 3 | 1 | 32% | 0.1 | 4 |
| R318Y/R338E/N346Y/R403E/E410N | R150Y/R170E/N178Y/R233E/E240N | 10000 | 0 | 0% | 517.0 | 2 |
| R318Y/R338E/T343R/N346Y/R403E/E410N | R150Y/R170E/T175R/N178Y/R233E/E240N | 10000 | 0 | 0% | 517.0 | 2 |
| T343R/N346D | T175R/N178D | 22 | 4 | 18% | 1.1 | 2 |
| R318Y/R338E/T343R/N346D/R403E/E410N | R150Y/R170E/T175R/N178D/R233E/E240N | 10000 | 0 | 0% | 517.0 | 2 |
| R318Y/R338E/Y345A/R403E/E410N | R150Y/R170E/Y177A/R233E/E240N | 10000 | 0 | 0% | 517.0 | 2 |
| R318Y/R338E/Y345A/N346D/R403E/E410N | R150Y/R170E/Y177A/N178D/R233E/E240N | 10000 | 0 | 0% | 517.0 | 2 |

A $K_{0.5}$ value of 999 nM indicates the lower limit value for those variants with less than 10% inhibition under the conditions of the standard assay (35 nM-0 nM AT-III).
Variants with >50% of WT $k_{cat}/K_M$ (see Example 4, Table 14) and initially given a $K_{0.5}$ value of 999 nM were retested at higher AT-III concentrations, expanding in the sensitivity of the assay.
A $K_{0.5}$ value of 10000 nM indicates the lower limit value for those variants with less than 10% inhibition under the conditions of the expanded sensitivity assay (1000 nM-0 nM AT-III and 5000-0 nM AT-III).

C. Determination of the Second-Order Rate Constant ($k_{app}$) for Inhibition of FIXa by the Antithrombin/UFH Complex Additional experiments were performed to measure the second-order rate constant for inhibition ($k_{app}$) of FIXa variants by AT-III/UFH using the same assay as described above in Example 5B with minor modifications. This method is more amenable to evaluating the second-order rate constants for multiple variants concurrently than the traditional competitive kinetic or discontinuous methods (see e.g., Olson et al. (2004) *Thromb Haemost* 92(5), 929-939).

For inhibition reactions in the presence of UFH, a 1000 nM solution of AT-III/UFH were prepared by dilution of a 20 µM stock of plasma purified human AT-III (Molecular Innovations) into a solution of excess UFH (2 µM) in a 1.0 mL volume of 1× Buffer A (50 mM Tris, 100 mM NaCl, 10 mM $CaCl_2$, 0.01% Tween-20, pH 7.4). AT-III/UFH solutions were incubated for 30 minutes at room temperature prior to being serially diluted 2.0-fold in a 96 deep-well polypropylene plate with a final volume of 500 µL 1× Buffer A containing 2 µM UFH. The final dilutions of AT-III for the modified $k_{app}$ assay ranged from 500 nM-0 nM (i.e. rows A-H). A total of 35 µL of each AT-III dilution was aliquoted into their respective rows of a 96-well V-bottom storage plate to fill all columns (i.e. 1-12). FIXa variants were initially diluted to 100 nM in 1× Buffer A. Subsequently, 50 µL of each 100 nM FIXa variant was diluted to a concentration of 2.0 nM in 2.5 mL of 1× Buffer A and then 70 µL of this solution was aliquoted into a 96-well V-bottom storage plate according to the same pre-defined plate map as above (4 FIXa variants per plate).

Assay reactions were initiated using a BioMek FX liquid handling system programmed to dispense 35 µL of the FIXa solutions into the plates containing 35 µL of each dilution of AT-III/UFH per well for a total of two duplicate assay plates for each FIXa variant. The final inhibition assay conditions were: 1.0 nM FIXa and AT-III dilutions ranging from 500 nM to 0 nM in 1 µM UFH so that the heparin remained in excess. Inhibition reactions were further incubated for various times at room temperature (~25° C.) depending on the expected inhibition rate constant and adjusted so that >90% inhibition could be reached at the highest concentration of AT-III in the assay (500 nM). Typical incubation times were determined specifically for each variant, or class of variants, but generally followed the incubation times outlined in Table 23.

TABLE 23

Assay Incubation Times Based on Expected $k_{app}$ Values

| Expected $k_{app}$ ($M^{-1}s^{-1}$) | FIXa/ATIII Incubation (sec) |
|---|---|
| 1.0E−07 | 10 |
| 1.0E−06 | 30 |
| 1.0E−05 | 120 |
| 1.0E−04 | 600 |
| 1.0E−03 | 3600 |
| 1.0E−02 | 7200 |

Following the desired incubation time a 40 µL aliquot of the reaction was transferred by the BioMek FX to a 96-well black half-area plate containing 20 µL of 2.5 mM Mesyl-D-CHG-Gly-Arg-AMC per well in assay Buffer C (50 mM Tris, 100 mM NaCl, 10 mM $CaCl_2$, 0.01% Tween-20, pH 7.4, 82% ethylene glycol and 5 mg/mL polybrene). Polybrene (hexadimethrine bromide) at a final concentration of 5 mg/mL was added to Buffer C to quench the AT-III/UFH reaction. Residual activity of FIXa was assessed by following the initial rates of substrate cleavage for 60 minutes in a fluorescence reader set to 25° C. The final assay conditions for determination of residual activity were 0.67 nM FIXa variant, 0.83 mM Mesyl-D-CHG-Gly-Arg-AMC, 30% ethylene glycol and 5 mg/mL polybrene in 50 mM Tris, 100 mM NaCl, 10 mM $CaCl_2$, 0.01% Tween-20, pH 7.4. Data analyses to calculate the $K_{0.5}$ value were performed in a similar manner as that described above for AT-III/UFH inhibition assays in Example B using the ActivityBase software package and the XE Runner data analysis module (IDBS Software). Using the assay set-up outlined in Example 5B under psuedo-1st-order conditions and testing various incubation times it is thus possible to calculate the apparent second-order rate constant for inhibition by AT-III ($k_{app}$) using the following equations:

$$k_{app} = \frac{k_{obs}}{\left(\frac{[AT\text{-}III]}{S.I.}\right)} \quad \text{Equation (1)}$$

$$k_{obs} = \frac{\ln(2)}{t_{1/2}} \quad \text{Equation (2)}$$

Given that the fit value for $K_{0.5}$=[AT-III] at $t_{1/2}$ (defined by the time of the assay) all the necessary values are available to calculate $k_{obs}$ and thus the $k_{app}$ for inhibition of a given FIXa variant by AT-HI. The calculated $k_{app}$ value does not take into account any potential effects of changes in the stoichiometry of inhibition (S.I.), which is given a constant value of 1.2 in the present calculations as this value reflects what is typically reported in the literature (see e.g., Olson et al. (2004) *Thromb Haemost* 92(5), 929-939).

Table 24 provides the results of the second-order rate assays that were performed using AT-III/UFH. The results are presented both as the fitted $k_{app}$ parameter and as a representation of the extent of AT-III resistance for each variant compared to the wild-type FIXa expressed as a ratio of their fitted $k_{app}$ values ($k_{app}$ wild-type/$k_{app}$ variant). Several FIXa variants exhibited greater than 10,000-20,000 fold increased resistance to AT-III compared to wild-type FIXa. For example, FIXa-R318A, FIXa-R318Y, FIXa-R338A/R403A, FIXa-R318Y/R338E/R403E, FIXa-R318Y/R338E/R403E, FIXa-K247N/N249S/R318Y/R338E/R403E, FIXa-R318Y/R338E/R403E, FIXa-K228N/I251S/R318Y/R338E/R403E/E410N, FIXa-R318Y/R338E/E410N and FIXa-R318Y/R338E/R403E/E410N are among this group, which exhibited significant resistance to AT-III.

TABLE 24

Second-Order Rate Constant for Inhibition by AT-III/UFH

| Mutation (Mature FIX Numbering) | Mutation (Chymotrypsin Numbering) | $k_{app}$ (M$^{-1}$s$^{-1}$) | ±S.D. (M$^{-1}$s$^{-1}$) | % CV | $k_{app\text{-}wt}/k_{app\text{-}mut}$ | n |
|---|---|---|---|---|---|---|
| BeneFIX Benefix ® Coagulation FIX (T148A) | BeneFIX Benefix ® Coagulation FIX (T[148]A) | 1.6E+07 | 1.7E+07 | 105% | 1 | 8 |
| Catalyst Biosciences WT | Catalyst Biosciences WT | 2.4E+07 | 8.0E+06 | 33% | 1 | 4 |
| T148A | T[148]A | 1.6E+07 | 1.1E+07 | 69% | 1 | 4 |
| D203N/F205T | D39N/F41T | 8.1E+05 | 5.3E+05 | 66% | 30 | 3 |
| D85N/D203N/F205T | D[85]N/D39N/F41T | 2.7E+06 | 4.5E+05 | 17% | 9 | 2 |
| N260S | N95S | 1.1E+06 | 2.1E+04 | 2% | 21 | 2 |
| D104N/K106S/N260S | D[104]N/K[106]S/N95S | 7.0E+06 | 1.9E+06 | 27% | 3 | 3 |
| R318A | R150A | 6.9E+05 | 5.6E+04 | 8% | 35 | 2 |
| R318E | R150E | 1.6E+04 | 1.2E+03 | 7% | 1,452 | 2 |
| R318Y | R150Y | 6.4E+05 | 3.5E+05 | 55% | 37 | 5 |
| R312Y | R143Y | 2.3E+05 | 4.5E+04 | 19% | 102 | 3 |
| R403A | R233A | 1.4E+06 | 3.1E+05 | 23% | 18 | 2 |
| R403E | R233E | 1.1E+05 | 2.4E+04 | 21% | 209 | 2 |
| K400E | R230E | 4.1E+06 | 3.3E+04 | 8% | 58 | 2 |
| K293E | K126E | 1.2E+06 | 8.4E+04 | 7% | 20 | 2 |
| R338E | R170E | 2.7E+05 | 1.7E+05 | 64% | 88 | 3 |
| R338A/R403A | R170A/R233A | 8.4E+05 | 4.6E+04 | 5% | 28 | 2 |
| R338E/R403E | R170E/R233E | 6.8E+04 | 1.9E+04 | 28% | 353 | 2 |
| K293A/R403A | K126A/R233A | 8.1E+04 | 1.5E+04 | 18% | 294 | 2 |
| K293A/R338A/R403A | K126A/R170A/R233A | 4.7E+04 | 7.9E+03 | 17% | 511 | 2 |
| K293E/R338E/R403E | K126E/R170E/R233E | 3.1E+04 | 6.3E+03 | 20% | 768 | 2 |
| R318A/R403A | R150A/R233A | 1.7E+04 | 4.7E+03 | 27% | 1,390 | 2 |
| R318Y/E410N | R150Y/E240N | 1.1E+06 | 7.9E+03 | 1% | 22 | 2 |
| R338E/E410N | R170E/E240N | 6.3E+06 | 7.4E+06 | 117% | 4 | 10 |
| R338E/R403E/E410N | R170E/R233E/E240N | 1.3E+05 | 1.5E+05 | 115% | 180 | 14 |
| Y155F/R338E/R403E/E410N | Y[155]F/R170E/R233E/E240N | 3.2E+04 | 1.7E+03 | 5% | 755 | 2 |
| R318Y/R338E/R403E | R150Y/R170E/R233E | 1.2E+03 | 9.9E+02 | 80% | 19,396 | 7 |
| Y155F/R318Y/R338E/R403E | Y[155]F/R150Y/R170E/R233E | 1.0E+03 | 5.4E+01 | 5% | 23,242 | 2 |
| D203N/F205T/K228N | D39N/F41T/K63N | 1.1E+06 | 3.7E+05 | 33% | 21 | 2 |
| D203N/F205T/E410N | D39N/F41T/E240N | 2.0E+06 | 2.1E+05 | 10% | 12 | 2 |
| D203N/F205T/R338E | D39N/F41T/R170E | 3.6E+05 | 2.8E+04 | 8% | 66 | 2 |
| D203N/F205T/R338A | D39N/F41T/R170A | 8.6E+05 | 1.6E+05 | 18% | 28 | 2 |
| D203N/F205T/R318Y | D39N/F41T/R150Y | 6.1E+04 | 2.0E+04 | 33% | 391 | 2 |
| D203N/F205T/R338E/R403E | D39N/F41T/R170E/R233E | 2.0E+03 | n.d. | n.d. | 12,250 | 1 |
| K228N/R318Y | K63N/R150Y | 1.2E+06 | 2.1E+05 | 17% | 19 | 2 |
| K228N/R338E/R403E | K63N/R170E/R233E | 4.2E+04 | 1.3E+04 | 31% | 567 | 2 |
| R403E/E410N | R233E/E240N | 4.8E+06 | 2.5E+06 | 53% | 5 | 5 |
| R318Y/R338E/E410N | R150Y/R170E/E240N | 2.8E+05 | 2.4E+05 | 85% | 84 | 8 |
| D104N/K106S/R318Y/R338E/E410N | D[104]N/K[106]S/R150Y/R170E/E240N | 2.1E+05 | 4.2E+04 | 20% | 113 | 2 |
| Y155F/R318Y/R338E/E410N | Y[155]F/R150Y/R170E/E240N | 4.5E+05 | 6.9E+04 | 15% | 53 | 2 |
| K228N/R318Y/E410N | K63N/R150Y/E240N | 1.9E+06 | n.d. | n.d. | 12 | 1 |
| R318Y/R403E/E410N | R150Y/R233E/E240N | 2.8E+04 | 1.8E+04 | 63% | 856 | 6 |
| Y155F/R318Y/R403E/E410N | Y[155]F/R150Y/R233E/E240N | 8.1E+03 | 1.4E+02 | 2% | 2,963 | 2 |
| R318Y/R338E/R403E/E410N | R150Y/R170E/R233E/E240N | 3.2E+03 | 2.0E+03 | 63% | 7,385 | 6 |
| A103N/N105S/R318Y/R338E/R403E/E410N | A[103]N/N[105]S/R150Y/R170E/R233E/E240N | 2.6E+03 | 1.7E+02 | 7% | 9,060 | 2 |
| D104N/K106S/R318Y/R338E/R403E/E410N | D[104]N/K[106]S/R150Y/R170E/R233E/E240N | 3.9E+03 | 1.6E+01 | 0% | 6,154 | 2 |
| Y155F/R318Y/R338E/R403E/E410N | Y[155]F/R150Y/R170E/R233E/E240N | 3.2E+03 | 8.1E+02 | 25% | 7,464 | 3 |
| A103N/N105S/Y155F/R318Y/R338E/R403E/E410N | A[103]N/N[105]S/Y[155]F/R150Y/R170E/R233E/E240N | 3.2E+03 | 6.7E+00 | 0% | 7,531 | 2 |
| D104N/K106S/Y155F/R318Y/R338E/R403E/E410N | D[104]N/K[106]S/Y[155]F/R150Y/R170E/R233E/E240N | 2.9E+03 | 1.8E+02 | 6% | 8,147 | 2 |
| D203N/F205T/R318Y/E410N | D39N/F41T/R150Y/E240N | 5.3E+04 | 5.8E+03 | 11% | 454 | 3 |
| N346D | N178D | 3.4E+06 | 1.6E+06 | 48% | 7 | 4 |
| Y155F/N346D | Y[155]F/N178D | 4.0E+06 | 5.4E+05 | 13% | 6 | 2 |

TABLE 24-continued

Second-Order Rate Constant for Inhibition by AT-III/UFH

| Mutation (Mature FIX Numbering) | Mutation (Chymotrypsin Numbering) | $k_{app}$ $(M^{-1}s^{-1})$ | ±S.D. $(M^{-1}s^{-1})$ | % CV | $k_{app\text{-}wt}/k_{app\text{-}mut}$ | n |
|---|---|---|---|---|---|---|
| N346Y | N178Y | 8.4E+05 | n.d. | n.d. | 28 | 1 |
| Y345T | Y177T | 1.8E+06 | 7.8E+03 | 0% | 13 | 2 |
| T343R | T175R | 4.2E+06 | 1.0E+04 | 0% | 6 | 2 |
| T343Q | T175Q | 2.1E+06 | 5.4E+05 | 25% | 11 | 2 |
| T343R/Y345T | T175R/Y177T | 5.0E+06 | 1.8E+05 | 4% | 5 | 2 |
| R318Y/R338E | R150Y/R170E | 6.2E+05 | 5.4E+04 | 9% | 39 | 2 |
| K228N/R318Y/R338E/R403E/E410N | K63N/R150Y/R170E/R233E/E240N | 2.9E+03 | 2.2E+02 | 7% | 8,212 | 2 |
| Y155F/K228N/R318Y/R338E/R403E/E410N | Y[155]F/K63N/R150Y/R170E/R233E/E240N | 4.6E+03 | 6.1E+02 | 13% | 5,161 | 2 |
| D85N/K228N/R318Y/R338E/R403E/E410N | D[85]N/K63N/R150Y/R170E/R233E/E240N | 3.0E+03 | 3.2E+02 | 11% | 7,932 | 2 |
| I251S/R318Y/R338E/R403E/E410N | I86S/R150Y/R170E/R233E/E240N | 3.0E+03 | 3.5E+02 | 12% | 7,940 | 2 |
| D104N/K106S/I251S/R318Y/R338E/R403E/E410N | D[104]N/K[106]S/I86S/R150Y/R170E/R233E/E240N | 5.7E+03 | 8.4E+02 | 15% | 4,225 | 2 |
| Y155F/I251S/R318Y/R338E/R403E/E410N | D[104]N/K[106]S/I86S/R150Y/R170E/R233E/E240N | 3.3E+03 | 1.4E+02 | 4% | 7,306 | 2 |
| I251S/R318Y/R338E/E410N | I86S/R150Y/R170E/E240N | 2.4E+05 | 2.1E+05 | 89% | 100 | 6 |
| D104N/K106S/I251S/R318Y/R338E/E410N | D[104]N/K[106]S/I86S/R150Y/R170E/E240N | 3.2E+03 | 4.5E+02 | 14% | 7,567 | 2 |
| K247N/N249S/R318Y/R338E/R403E/E410N | K82N/N84S/R150Y/R170E/R233E/E240N | 2.0E+03 | 1.0E+03 | 53% | 12,122 | 2 |
| Y155F/K247N/N249S/R318Y/R338E/R403E/E410N | Y[155]F/K82N/N84S/R150Y/R170E/R233E/E240N | 1.6E+03 | 5.9E+02 | 37% | 15,058 | 4 |
| A103N/N105S/K247N/N249S/R318Y/R338E/R403E/E410N | A[103]N/N[105]S/K82N/N84S/R150Y/R170E/R233E/E240N | 1.7E+03 | 2.4E+02 | 14% | 14,063 | 3 |
| D104N/K106S/K247N/N249S/R318Y/R338E/R403E/E410N | D[104]N/K[106]S/K82N/N84S/R150Y/R170E/R233E/E240N | 3.1E+03 | 7.6E+02 | 24% | 7,646 | 3 |
| D104N/K106S/Y155F/K247N/N249S/R318Y/R338E/R403E/E410N | D[104]N/K[106]S/Y[155]F/K82N/N84S/R150Y/R170E/R233E/E240N | 1.0E+03 | 2.8E+02 | 28% | 23,776 | 6 |
| K247N/N249S/R318Y/R338E/E410N | K82N/N84S/R150Y/R170E/E240N | 8.6E+05 | 1.2E+05 | 14% | 28 | 2 |
| Y155F/K247N/N249S/R318Y/R338E/E410N | Y[155]F/K82N/N84S/R150Y/R170E/E240N | 1.8E+05 | 2.2E+04 | 13% | 136 | 2 |
| R318Y/R338E/R403E/E410S | R150Y/R170E/R233E/E240S | 1.6E+03 | 1.1E+03 | 64% | 14,483 | 7 |
| R318Y/R338E/E410S | R150Y/R170E/E240S | 7.2E+05 | 4.8E+05 | 66% | 33 | 2 |
| K228N/K247N/N249S/R318Y/R338E/R403E/E410N | K63N/K82N/N84S/R150Y/R170E/R233E/E240N | 1.1E+03 | 4.5E+02 | 41% | 21,766 | 12 |
| D104N/K106S/K228N/K247N/N249S/R318Y/R338E/R403E/E410N | D[104]N/K[106]S/K63N/K82N/N84S/R150Y/R170E/R233E/E240N | 6.8E+02 | 3.3E+02 | 48% | 35,018 | 4 |
| Y155F/K228N/K247N/N249S/R318Y/R338E/R403E/E410N | Y[155]F/K63N/K82N/N84S/R150Y/R170E/R233E/E240N | 1.1E+03 | 3.9E+01 | 4% | 21,856 | 4 |
| R318Y/R338E/R403E/E410N/T412V | R150Y/R170E/R233E/E240N/T242V | 2.9E+03 | 5.4E+02 | 19% | 8,296 | 5 |
| R318Y/R338E/R403E/E410N/T412A | R150Y/R170E/R233E/E240N/T242A | 3.8E+03 | 1.2E+03 | 31% | 6,322 | 5 |
| R318Y/R338E/R403E/T412A | R150Y/R170E/R233E/T242A | 1.6E+03 | 3.8E+02 | 23% | 14,529 | 2 |
| R318Y/R338E/T412A | R150Y/R170E/T242A | 3.5E+05 | 7.2E+04 | 21% | 69 | 3 |
| R318Y/R338E/E410N/T412V | R150Y/R170E/E240N/T242V | 3.9E+05 | 2.6E+04 | 7% | 61 | 2 |
| N260S/R318Y/R338E/R403E/E410N | N95S/R150Y/R170E/R233E/E240N | 4.4E+03 | 8.5E+02 | 19% | 5,407 | 2 |
| D104N/K106S/N260S/R318Y/R338E/R403E/E410N | D[104]N/K[106]S/N95S/R150Y/R170E/R233E/E240N | 2.1E+03 | 3.9E+02 | 18% | 11,173 | 2 |
| Y155F/N260S/R318Y/R338E/R403E/E410N | Y[155]F/N95S/R150Y/R170E/R233E/E240N | 2.1E+03 | 2.4E+02 | 11% | 11,456 | 2 |
| R318Y/R338E/N346D/R403E/E410N | R150Y/R170E/N178D/R233E/E240N | 1.1E+03 | 5.5E+02 | 49% | 21,504 | 6 |
| Y155F/R318Y/R338E/N346D/R403E/E410N | Y[155]F/R150Y/R170E/N178D/R233E/E240N | 1.6E+03 | 6.6E+02 | 41% | 14,831 | 3 |
| D104N/K106S/K247N/N249S/N260S | D[104]N/K[106]S/K82N/N84S/N95S | 1.7E+06 | 8.7E+04 | 5% | 14 | 2 |
| D104N/K106S/Y155F/K247N/N249S/N260S | D[104]N/K[106]S/Y[155]F/K82N/N84S/N95S | 3.2E+06 | 2.1E+05 | 6% | 7 | 2 |
| K247N/N249S/N260S/R318Y/R338E/R403E/E410N | K82N/N84S/N95S/R150Y/R170E/R233E/E240N | 1.3E+03 | 3.8E+02 | 30% | 18,567 | 2 |
| Y155F/K247N/N249S/N260S/R318Y/R338E/R403E/E410N | Y[155]F/K82N/N84S/N95S/R150Y/R170E/R233E/E240N | 4.3E+02 | 3.8E+00 | 1% | 55,342 | 4 |

TABLE 24-continued

Second-Order Rate Constant for Inhibition by AT-III/UFH

| Mutation (Mature FIX Numbering) | Mutation (Chymotrypsin Numbering) | $k_{app}$ ($M^{-1}s^{-1}$) | ±S.D. ($M^{-1}s^{-1}$) | % CV | $k_{app-wt}/k_{app-mut}$ | n |
|---|---|---|---|---|---|---|
| R318Y/R338E/T343R/R403E/E410N | R150Y/R170E/T175R/R233E/E240N | 3.2E+04 | 2.2E+04 | 69% | 749 | 6 |
| Y155F/R318Y/R338E/T343R/R403E/E410N | Y[155]F/R150Y/R170E/T175R/R233E/E240N | 8.6E+03 | 5.4E+03 | 63% | 2,774 | 6 |
| D104N/K106S/R318Y/R338E/T343R/R403E/E410N | D[104]N/K[106]S/R150Y/R170E/T175R/R233E/E240N | 9.1E+03 | 2.4E+03 | 27% | 2,636 | 4 |
| R338E/T343R | R170E/T175R | 3.4E+06 | 4.8E+05 | 14% | 7 | 2 |
| T343R/N346Y | T175R/N178Y | 4.2E+06 | 4.0E+06 | 95% | 6 | 4 |
| R318Y/R338E/N346Y/R403E/E410N | R150Y/R170E/N178Y/R233E/E240N | 2.8E+03 | 4.4E+02 | 16% | 8,498 | 2 |
| R318Y/R338E/T343R/N346Y/R403E/E410N | R150Y/R170E/T175R/N178Y/R233E/E240N | 1.1E+04 | 4.3E+03 | 37% | 2,086 | 4 |
| T343R/N346D | T175R/N178D | 1.3E+06 | 2.3E+05 | 18% | 18 | 2 |
| R318Y/R338E/T343R/N346D/R403E/E410N | R150Y/R170E/T175R/N178D/R233E/E240N | 5.1E+03 | 3.7E+01 | 1% | 4,726 | 2 |
| R318Y/R338E/Y345A/R403E/E410N | R150Y/R170E/Y177A/R233E/E240N | 7.9E+03 | 1.2E+03 | 16% | 3,015 | 2 |
| Y155F/K247N/N249S/R318Y/R338E/R403E | Y[155]F/K82N/N84S/R150Y/R170E/R233E | 8.1E+02 | 1.6E+02 | 20% | 29,512 | 4 |
| K247N/N249S/R318Y/R338E/R403E | K82N/N84S/R150Y/R170E/R233E | 3.1E+02 | 2.1E+02 | 67% | 76,373 | 4 |
| Y155F/K247N/N249S/R318Y/R403E/E410N | Y[155]F/K82N/N84S/R150Y/R233E/E240N | 7.3E+03 | 2.0E+01 | 0% | 3,291 | 2 |
| K247N/N249S/R318Y/R403E/E410N | K82N/N84S/R150Y/R233E/E240N | 2.7E+03 | 9.3E+02 | 35% | 8,942 | 6 |
| Y155F/K247N/N249S/R338E/R403E/E410N | Y[155]F/K82N/N84S/R170E/R233E/E240N | 4.2E+04 | 4.3E+02 | 1% | 572 | 2 |
| K247N/N249S/R338E/R403E/E410N | K82N/N84S/R170E/R233E/E240N | 2.1E+04 | 1.5E+03 | 7% | 1,148 | 2 |
| R318Y/R338E/T343R/R403E | R150Y/R170E/T175R/R233E | 5.8E+03 | 8.6E+02 | 15% | 4,118 | 2 |
| Y155F/R318Y/R338E/T343R/R403E | Y[155]F/R150Y/R170E/T175R/R233E | 2.8E+03 | 3.8E+02 | 14% | 8,515 | 6 |
| R318Y/R338E/T343R/E410N | R150Y/R170E/T175R/E240N | 5.4E+05 | 3.2E+05 | 58% | 44 | 8 |
| Y155F/R318Y/R338E/T343R/E410N | Y[155]F/R150Y/R170E/T175R/E240N | 7.8E+05 | 6.1E+05 | 79% | 31 | 4 |
| R318Y/T343R/R403E/E410N | R150Y/T175R/R233E/E240N | 9.3E+04 | 1.2E+04 | 13% | 257 | 2 |
| Y155F/R318Y/T343R/R403E/E410N | Y[155]F/R150Y/T175R/R233E/E240N | 5.5E+04 | 7.8E+03 | 14% | 436 | 4 |
| R338E/T343R/R403E/E410N | R170E/T175R/R233E/E240N | 3.4E+05 | 2.7E+03 | 1% | 70 | 2 |
| Y155F/R338E/T343R/R403E/E410N | Y[155]F/R170E/T175R/R233E/E240N | 2.8E+05 | 1.7E+04 | 6% | 85 | 4 |
| Y155F/K247N/N249S/R318Y/R338E/T343R/R403E/E410N | Y[155]F/K82N/N84S/R150Y/R170E/T175R/R233E/E240N | 8.7E+03 | 1.9E+03 | 22% | 2,733 | 8 |
| K247N/N249S/R318Y/R338E/T343R/R403E/E410N | K82N/N84S/R150Y/R170E/T175R/R233E/E240N | 9.6E+03 | 2.4E+03 | 25% | 2,499 | 4 |
| K228N/I251S/R318Y/R338E/R403E/E410N | K63N/I86S/R150Y/R170E/R233E/E240N | 9.0E+02 | 2.2E+02 | 25% | 26,598 | 4 |
| Y155F/K228N/I251S/R318Y/R338E/R403E/E410N | Y[155]F/K63N/I86S/R150Y/R170E/R233E/E240N | 1.3E+03 | 2.8E+02 | 21% | 17,778 | 6 |
| N260S/R318Y/R338E/T343R/R403E/E410N | N95S/R150Y/R170E/T175R/R233E/E240N | 2.6E+03 | 5.6E+02 | 22% | 9,317 | 4 |
| Y155F/N260S/R318Y/R338E/T343R/R403E/E410N | Y[155]F/N95S/R150Y/R170E/T175R/R233E/E240N | 2.6E+03 | 6.6E+02 | 25% | 9,148 | 4 |
| K228N/K247N/N249S/R318Y/R338E/T343R/R403E/E410N | K63N/K82N/N84S/R150Y/R170E/T175R/R233E/E240N | 5.3E+03 | 1.8E+03 | 34% | 4,468 | 10 |
| Y155F/K228N/K247N/N249S/R318Y/R338E/T343R/R403E/E410N | Y[155]F/K63N/K82N/N84S/R150Y/R170E/T175R/R233E/E240N | 2.2E+03 | 1.4E+03 | 62% | 10,758 | 4 |
| Y155F/R338E/T343R/R403E | Y[155]F/R170E/T175R/R233E | 9.3E+04 | 1.2E+04 | 13% | 257 | 4 |
| R338E/T343R/R403E | R170E/T175R/R233E | 1.9E+05 | 7.1E+02 | 0% | 125 | 2 |
| Y155F/R338E/T343R/R403E/E410S | Y[155]F/R170E/T175R/R233E/E240S | 2.2E+05 | 2.6E+04 | 12% | 110 | 6 |
| Y155F/N260S/R338E/T343R/R403E | Y[155]F/N95S/R170E/T175R/R233E | 4.0E+04 | 7.6E+03 | 19% | 601 | 4 |
| Y155F/I251S/R338E/T343R/R403E | Y[155]F/I86S/R170E/T175R/R233E | 1.6E+05 | 1.5E+04 | 9% | 146 | 2 |
| R318Y/R338E/T343R/R403E/E410S | R150Y/R170E/T175R/R233E/E240S | 9.9E+03 | 2.9E+03 | 30% | 2,417 | 22 |
| Y155F/K247N/N249S/T343R/R403E | Y[155]F/K82N/N84S/T175R/R233E | 1.4E+05 | 2.3E+04 | 16% | 168 | 4 |

TABLE 24-continued

Second-Order Rate Constant for Inhibition by AT-III/UFH

| Mutation (Mature FIX Numbering) | Mutation (Chymotrypsin Numbering) | $k_{app}$ ($M^{-1}s^{-1}$) | ±S.D. ($M^{-1}s^{-1}$) | % CV | $k_{app-wt}$/ $k_{app-mut}$ | n |
|---|---|---|---|---|---|---|
| Y155F/K247N/N249S/R318Y/R338E/T343R/R403E | Y[155]F/K82N/N84S/R150Y/R170E/T175R/R233E | 2.3E+03 | 1.7E+02 | 8% | 10,415 | 2 |
| K247N/N249S/R318Y/R338E/T343R/R403E | K82N/N84S/R150Y/R170E/T175R/R233E | 1.7E+03 | 2.0E+02 | 12% | 14,156 | 4 |
| Y155F/K247N/N249S/R338E/T343R/R403E/E410N | Y[155]F/K82N/N84S/R170E/T175R/R233E/E240N | 8.9E+04 | 1.1E+04 | 13% | 268 | 4 |
| K247N/N249S/R338E/T343R/R403E/E410N | K82N/N84S/R170E/T175R/R233E/E240N | 8.6E+04 | 1.1E+04 | 13% | 276 | 4 |
| Y155F/K247N/N249S/R318Y/R338E | Y[155]F/K82N/N84S/R150Y/R170E | 2.7E+04 | 1.4E+04 | 50% | 889 | 4 |
| Y155F/K247N/N249S/R318Y/T343R | Y[155]F/K82N/N84S/R150Y/T175R | 4.0E+05 | 2.9E+05 | 72% | 60 | 8 |
| Y155F/K247N/N249S/R318Y/R403E | Y[155]F/K82N/N84S/R150Y/R233E | 2.1E+03 | 5.3E+01 | 2% | 11,125 | 2 |
| Y155F/K247N/N249S/R318Y/E410N | Y[155]F/K82N/N84S/R150Y/E240N | 1.3E+05 | 9.5E+04 | 75% | 188 | 6 |
| Y155F/K247N/N249S/R338E/R403E | Y[155]F/K82N/N84S/R170E/R233E | 1.3E+04 | 1.0E+03 | 8% | 1,819 | 2 |
| Y155F/K247N/N249S/R338E/T343R | Y[155]F/K82N/N84S/R170E/T175R | 1.2E+07 | 6.2E+06 | 51% | 2 | 4 |
| Y155F/K247N/N249S/R318Y/R338E/T343R/E410N | Y[155]F/K82N/N84S/R150Y/R170E/T175R/E240N | 2.2E+05 | 1.0E+05 | 45% | 107 | 4 |
| K247N/N249S/R318Y/R338E/T343R/E410N | K82N/N84S/R150Y/R170E/T175R/E240N | 2.1E+05 | 8.2E+04 | 39% | 114 | 4 |
| Y155F/K247N/N249S/R318Y/T343R/R403E/E410N | Y[155]F/K82N/N84S/R150Y/T175R/R233E/E240N | 2.8E+04 | 5.6E+03 | 20% | 842 | 4 |
| K247N/N249S/R318Y/T343R/R403E/E410N | K82N/N84S/R150Y/T175R/R233E/E240N | 2.5E+04 | 8.0E+03 | 32% | 962 | 6 |
| Y155F/K247N/N249S/R338E/E410N | Y[155]F/K82N/N84S/R170E/E240N | 2.9E+06 | 2.2E+06 | 77% | 8 | 6 |
| Y155F/K247N/N249S/R318Y/T343R/R403E | Y[155]F/K82N/N84S/R150Y/T175R/R233E | 1.2E+04 | 1.0E+03 | 9% | 2,011 | 4 |
| K247N/N249S/R318Y/T343R/R403E | K82N/N84S/R150Y/T175R/R233E | 9.8E+03 | 2.5E+03 | 26% | 2,430 | 12 |
| Y155F/K247N/N249S/R318Y/T343R/E410N | Y[155]F/K82N/N84S/R150Y/T175R/E240N | 3.6E+05 | 1.2E+05 | 32% | 66 | 4 |
| K247N/N249S/R318Y/T343R/E410N | K82N/N84S/R150Y/T175R/E240N | 4.9E+04 | 6.5E+03 | 13% | 487 | 4 |
| Y155F/K247N/N249S/R338E/T343R/R403E | Y[155]F/K82N/N84S/R170E/T175R/R233E | 4.4E+04 | 1.1E+04 | 26% | 549 | 4 |
| K247N/N249S/R338E/T343R/R403E | K82N/N84S/R170E/T175R/R233E | 5.0E+04 | 1.7E+04 | 35% | 482 | 4 |
| K247N/N249S/R338E/T343R/E410N | K82N/N84S/R170E/T175R/E240N | 1.4E+07 | 7.2E+06 | 53% | 2 | 5 |
| Y155F/K247N/N249S/T343R/R403E/E410N | Y[155]F/K82N/N84S/T175R/R233E/E240N | 6.2E+05 | 5.6E+04 | 9% | 39 | 4 |
| K247N/N249S/T343R/R403E/E410N | K82N/N84S/T175R/R233E/E240N | 4.2E+05 | 8.1E+04 | 19% | 58 | 4 |
| Y155F/R318Y/R338E/T343R | Y[155]F/R150Y/R170E/T175R | 4.4E+05 | 1.9E+05 | 43% | 55 | 6 |
| R318Y/R338E/T343R | R150Y/R170E/T175R | 1.8E+06 | 8.6E+05 | 48% | 13 | 4 |
| Y155F/R318Y/T343R/R403E | Y[155]F/R150Y/T175R/R233E | 1.1E+04 | 9.1E+02 | 8% | 2,114 | 2 |
| Y155F/T343R/R403E/E410N | Y[155]F/T175R/R233E/E240N | 8.8E+05 | 3.3E+03 | 0% | 27 | 2 |
| Y155F/K247N/N249S/R318Y/R338E/T343R | Y[155]F/K82N/N84S/R150Y/R170E/T175R | 3.7E+05 | 1.1E+05 | 28% | 64 | 6 |
| K247N/N249S/R318Y/R338E/T343R | K82N/N84S/R150Y/R170E/T175R | 3.2E+05 | 1.4E+05 | 44% | 74 | 6 |
| Y155F/K247N/N249S/T343R/E410N | Y[155]F/K82N/N84S/T175R/E240N | 3.5E+06 | 4.8E+05 | 14% | 7 | 2 |
| Y155F/K247N/N249S/R403E/E410N | Y[155]F/K82N/N84S/R233E/E240N | 1.3E+05 | 3.3E+04 | 26% | 191 | 14 |
| Y155F/R338E/T343R/E410N | Y[155]F/R170E/T175R/E240N | 1.3E+07 | 1.0E+07 | 78% | 2 | 6 |
| R338E/T343R/E410N | R170E/T175R/E240N | 2.0E+07 | 6.3E+06 | 31% | 1 | 4 |
| Y155F/R318Y/T343R/E410N | Y[155]F/R150Y/T175R/E240N | 2.0E+05 | 5.9E+04 | 29% | 118 | 4 |
| R318Y/T343R/E410N | R150Y/T175R/E240N | 1.2E+06 | 1.1E+05 | 9% | 20 | 2 |
| K228N/R150Y/R338E/T343R/R403E/E410N | K63N/R150Y/R170E/T175R/R233E/E240N | 7.1E+03 | 3.3E+02 | 5% | 3,343 | 2 |
| K228N/K247N/N249S/R318Y/R338E/T343R/R403E | K63N/K82N/N84S/R150Y/R170E/T175R/R233E | 1.0E+03 | 2.3E+02 | 22% | 23,389 | 2 |
| K228N/247N/N249S/R318Y/R338E/T343R/E410N | K63N/K82N/N84S/R150Y/R170E/T175R/E240N | 6.3E+05 | 1.0E+05 | 17% | 38 | 2 |
| K228N/K247N/N249S/R318Y/T343R/R403E/E410N | K63N/K82N/N84S/R150Y/T175R/R233E/E240N | 1.7E+04 | 2.4E+03 | 14% | 1,422 | 2 |

Example 6

Pharmacokinetic and Pharmacodynamic Analysis of FIXa Polypeptides

The pharmacokinetic (PK) and pharmacodynamic (PD) properties of the FIXa variant polypeptides were assessed by measuring the amount of variant FIX in mouse plasma at various timepoints following intravenous administration. Two assays were used to quantify FIXa in plasma. An ELISA was used to quantify total FIX protein in mouse plasma to assess the pharmacokinetic properties, and a FIX-dependant clotting assay (activated partial thromboplastin time (aPTT) assay using FIX-depleted plasma) was used to quantify the coagulant activity of the FIX polypeptides in plasma, thus assessing the pharmacodynamic properties.

Animals.

Male CD-1 mice (30-40 gm), supplied by Charles River Laboratories (Hollister, Calif.) were quarantined for at least 3 days before treatment. For serial PK studies, male CD-1 mice (30-37 gm) were fitted with an indwelling jugular vein cannula. Filtered tap water and food was available ad libitum prior to use in PD or PK experiments.

A. Dosing and Blood Collection

Mice (N=3 per time point) were administered the FIX polypeptides intravenously (~1.4 mg/kg for PK studies and ~400 IU/kg for PD studies, dose volume 2 ml/kg) via the tail vein. At the appropriate time after dosing, animals were anesthetized and blood was drawn (0.5-1 mL) using terminal cardiac puncture into syringes containing citrate. In some experiments where insufficient amount of protein was available, a total of only 4-6 animals were used for serial bleeding at staggered time points; two mice were used for each full time course in order to collect all time points without removing excess blood volume. Blood was sampled in restrained conscious animals by first removing a small amount of blood into a 0.1 mL syringe containing 0.9% saline. A syringe containing 4.5 μl of 0.1M sodium citrate was then attached and 0.05 mL blood was withdrawn into the syringe and the blood was transferred to a 1.5 mL tube. The initial syringe was reattached and 0.07 mL of saline pushed back through the cannula. The cannula was capped until the next time point, when the process was repeated. For all studies, blood samples were centrifuged within 15 minutes of collection (9000 rpm, 8 minutes, 4° C.) and the plasma removed and immediately flash frozen in liquid nitrogen and then stored frozen (-70° C.) pending analysis.

A. PK Assessment.

Citrated blood samples were collected at various times up to 1440 min post dose (i.e., Predose, 2, 4, 10, 30, 60, 120, 240, 360, 480, 960 and 1440 min) by cardiac puncture for terminal experiments or indwelling catheter for serial experiments. Plasma concentrations of rFIX were determined using a factor IX specific ELISA utilizing a matched pair of detection and capture antibodies (#FIX-EIA, Affinity Biologicals, Ancaster, ON). Briefly, an affinity purified polyclonal antibody to FIX is coated onto the wells of a plate. The plates are washed and plasma samples containing FIX are applied. Plasma samples are diluted 1:750 and 1:1500 on the plate. After washing the plate to remove unbound material, a peroxidase conjugated detection antibody to FIX is added to the plate to bind to the captured FIX. After washing the plate to remove unbound conjugated antibody, the peroxidase activity is expressed by incubation with chemiluminescent substrate and read at 425 nM on an EnVision plate reader. The standard curve is linear over the entire concentration range and spans the concentrations of 0.82 pg/ml to 30 ng/ml. The FIX variant itself is used for the standard curve to eliminate differences in the antibody affinity. Each sample is measured on two separate assay plates and those measurements within the range of the standard curve are used to calculate the concentration of FIX variants in the plasma sample.

PD Assessment. The plasma pharmacodynamic activity of rFIX was quantified using an activated partial thromboplastin time (aPTT) assay and FIX deficient human plasma (STA-CLOT C.K. PREST kit, Diagnostica Stago, Asnieres, France) per the manufacturer's instructions. Briefly, the aPTT assay involves the recalcification of plasma in the presence of cephalin (platelet substitute) and activator (koalin). Using FIX deficient human plasma, the aPTT assay is specific for FDC. The aPTT assay was performed as described in the manufacturers' product insert. Briefly, citrated blood samples were collected at the same time points described for PK assessment. Plasma samples were diluted 1:100 in Tris buffered saline containing 0.1% bovine serum albumin (Probumin, Millipore, Billerica, Mass.). Diluted plasma or standard was combined with FIX deficient human plasma and cephalin/kaolin reagent and incubated for 180 seconds. Coagulation was initiated by the addition of calcium ($CaCl_2$). Coagulation time in seconds was measured using an STArt4 instrument (Diagnostica Stago, Asnieres, France). Using a standard curve made from known concentrations of rFIX, plasma FIX concentrations were interpolated from the log concentration VS. log time standard curve plot and then background FIX activity (from pre dose animals) was subtracted. The lower limit of quantification for factor IX activity was ~10 ng/mL.

PD and PK Data Analysis. PD (aPTT) and PK (ELISA) parameters from mouse studies with rFIX variants were calculated using non compartmental analysis in WinNonLin (v5.1, Pharsight Corp., Mountain View, Calif.). Both the PD and PK of rFIX variants followed apparent biexponential plasma decay. Select parameters for each variant tested are provided in Table 25 for PD (using the aPTT assay) and Tables 26-27 for PK (using the ELISA assay). Table 26 reflects data for additional FIXa variants and provide new overall averages calculated to include additional experimental replicates (n) for FIXa variants in Table 26. The PD parameters included half-life (terminal, min), MRT ($MRT_{0-inf}$, min), Area under the curve (AUC) 0-last (min·μg/mL)/Dose (mg/kg); Maximal concentration ($C_{max}$; (μg/mL)/Dose (μg/kg), Vd (mL/kg) and Clearance (Cl, mL/min/kg).

Definitions and Formulae Used to Calculate Pharmacokinetic Parameters.

Plasma half-life (the half life of the FIX polypeptide during the terminal phase of plasma FIX concentration-versus-time profile; $T_{1/2\ \beta}$ (calculated as $-\ln 2$ divided by the negative slope during the terminal phase of the log-linear plot of the plasma FIX concentration-versus-time curve); $MRT_{0-last}$ is the mean time the FIX polypeptide resides in body; calculated as $AUMC_{0-last}/AUC_{0-last}$, where $AUMC_{0-last}$ is the total area under the first moment-versus-time curve and AUC as described subsequently); $AUC_{0-last}$/Dose is calculated as $[AUC_{(0-t)}]$, where t is the last time point with measurable plasma concentration of the FIX polypeptide divided by the IV dose (mg/kg); $AUC_{0-inf}$/Dose is calculated as $[AUC_{(0-t)} + Ct/(\ln 2/T_{1/2\ \beta})]$, where t is the last time point with measurable plasma concentration of the FIX polypeptide divided by the IV dose (mg/kg); C./Dose (ug/mL per mg/kg), where $C_{max}$ is the time post dose corresponding to the maximal measured plasma FIX concentration; Cl is systemic clearance calculated as (Dose/AUC$_{0-inf}$); V$_{ss}$ is the steady state volume of distribution; calculated as MRT*Cl; and V$_z$ is the volume of distribution based on the terminal elimination constant (β); calculated as Cl/(ln 2/T$_{1/2\,\beta}$).

TABLE 25

PD properties of FIX variants assessed by aPTT assay

| Mutation (Mature FIX numbering) | N | T$_{1/2\beta}$ | MRT$_{0-inf}$ | C$_{max}$/dose | AUC$_{0-inf}$ | Cl | Vz | Vss |
|---|---|---|---|---|---|---|---|---|
| BeneFIX ® Coagulation FIX (T148A) | 2 | 296 | 354 | 19.3 | 2641 | 0.41 | 169 | 142 |

TABLE 26

PK properties of FIX variants assessed by ELISA

| Mutation | N | T½$_\beta$ | MRT 0-inf | Cmax/Dose | AUC/Dose 0-last | AUC/Dose 0-inf | Vz | Cl |
|---|---|---|---|---|---|---|---|---|
| BeneFIX ® Coagulation FIX (T148A) | 3 | 314 ± 128 | 366 ± 105 | 9.1 ± 1.5 | 1298 ± 298 | 1522 ± 158 | 308 ± 160 | 0.74 ± 0.06 |
| T148A | 8 | 383 ± 109 | 435 ± 128 | 10.2 ± 2.1 | 1620 ± 195 | 1747 ± 234 | 317 ± 82 | 0.58 ± 0.08 |
| Catalyst Biosciences WT | 2 | 329 | 360 | 11.9 | 2036 | 2121 | 229 | 0.48 |
| A103N/N105S | 2 | 375 | 481 | 12.5 | 2841 | 3068 | 177 | 0.33 |
| D104N/K106S | 2 | 428 | 558 | 13.9 | 3379 | 3786 | 164 | 0.26 |
| K106N/V108S | 2 | 510 | 629 | 12.8 | 2748 | 3202 | 234 | 0.32 |
| D85N | 2 | 528 | 607 | 9.5 | 1798 | 2046 | 372 | 0.49 |
| D64N | 2 | 447 | 519 | 11.8 | 1933 | 2152 | 304 | 0.47 |
| D64A | 2 | 364 | 372 | 11.5 | 1351 | 1466 | 359 | 0.68 |
| N167D | 2 | 334 | 318 | 8.9 | 1129 | 1176 | 410 | 0.85 |
| N167Q | 3 | 337 ± 8.8 | 323 ± 4.2 | 8.2 ± 1.2 | 1495 ± 258 | 1554 ± 268 | 318 ± 42 | 0.66 ± 0.10 |
| S61A | 2 | 397 | 412 | 10.0 | 1685 | 1800 | 325 | 0.57 |
| S53A | 2 | 382 | 462 | 11.2 | 2146 | 2321 | 238 | 0.43 |
| T159A | 2 | 232 | 227 | 10.5 | 1036 | 1048 | 315 | 0.97 |
| T169A | 2 | 348 | 319 | 8.3 | 836 | 889 | 567 | 1.15 |
| T172A | 3 | 494 ± 187 | 571 ± 214 | 11.2 ± 2.9 | 2055 ± 408 | 2366 ± 676 | 295 ± 31 | 0.45 ± 0.13 |
| T179A | 2 | 377 | 431 | 12.5 | 2291 | 2458 | 223 | 0.42 |
| Y155H | 2 | 465 | 552 | 11.6 | 2365 | 2638 | 253 | 0.38 |
| Y155Q | 1 | 552 | 645 | 13.6 | 2583 | 3045 | 262 | 0.33 |
| S158E | 2 | 433 | 471 | 14.5 | 2029 | 2222 | 291 | 0.46 |
| N157Q | 2 | 335 | 352 | 11.3 | 1185 | 1238 | 395 | 0.83 |
| N157D | 2 | 290 | 265 | 9.9 | 1166 | 1211 | 393 | 0.93 |
| Y155F | 2 | 443 | 567 | 18.1 | 3941 | 4375 | 149 | 0.23 |
| A103N/N105S/Y155F | 2 | 562 | 619 | 13.1 | 2427 | 2496 | 325 | 0.40 |
| D104N/K106S/Y155F | 3 | 514 ± 80 | 581 ± 81 | 13.8 ± 1.0 | 3057 ± 1032 | 3181 ± 989 | 243 ± 47 | 0.34 ± 0.13 |
| D203N/F205T | 3 | 481 ± 69 | 566 ± 29 | 9.4 ± 1.9 | 2028 ± 448 | 2289 ± 489 | 314 ± 91 | 0.45 ± 0.09 |
| D203N/F205T/D85N | 1 | 291 | 406 | 12.4 | 1538 | 2044 | 205 | 0.49 |
| K228N/D85N | 2 | 459 | 565 | 11.3 | 2616 | 2926 | 227 | 0.35 |
| K228N/A103N/N105S | 2 | 583 | 701 | 14.4 | 3032 | 3301 | 255 | 0.30 |
| K228N/D104N/K106S | 2 | 801 | 913 | 13.6 | 2050 | 2238 | 513 | 0.45 |
| K228N/Y155F | 2 | 626 | 679 | 8.6 | 2073 | 2149 | 431 | 0.47 |
| K228N/D104N/K106S/Y155F | 2 | 551 | 614 | 14.0 | 3730 | 3822 | 211 | 0.27 |
| I251S | 2 | 565 | 718 | 10.1 | 2646 | 3137 | 260 | 0.32 |
| I251S/A103N/N105S | 2 | 444 | 542 | 14.3 | 2445 | 2719 | 241 | 0.38 |
| I251S/D104N/K106S | 2 | 692 | 802 | 13.9 | 2533 | 2664 | 375 | 0.38 |
| I251S/Y155F | 2 | 572 | 660 | 12.2 | 2591 | 2790 | 291 | 0.37 |
| A262S | 3 | 373 ± 87 | 453 ± 91 | 14.4 ± 3.8 | 2716 ± 732 | 2926 ± 908 | 188 ± 29 | 0.36 ± 0.10 |
| E410N* | 2 | 439 | 551 | 7.4 | 893 | 1365 | 469 | 0.75 |
| E239N | 2 | 338 | 416 | 10.7 | 1657 | 1908 | 257 | 0.54 |
| K247N/N249S | 6 | 627 ± 174 | 734 ± 244 | 10.8 ± 3.4 | 2196 ± 737 | 2545 ± 795 | 387 ± 154 | 0.42 ± 0.11 |
| Y155F/K247N/N249S | 2 | 538 | 608 | 10.6 | 1752 | 1880 | 420 | 0.53 |
| K247N/N249S/A103N/N105S | 2 | 736 | 852 | 21.5 | 4369 | 4699 | 226 | 0.21 |
| K247N/N249S/D104N/K106S/Y155F | 2 | 603 | 714 | 16.8 | 3744 | 3889 | 233 | 0.27 |
| S319N/L321S | 2 | 351 | 427 | 11.4 | 2270 | 2409 | 210 | 0.42 |
| N260S | 3 | 496 ± 157 | 619 ± 170 | 11.5 ± 3.8 | 3364 ± 1300 | 3687 ± 1457 | 231 ± 156 | 0.30 ± 0.11 |
| D104N/K106S/N260S | 2 | 805 | 1001 | 16.1 | 4736 | 5248 | 220 | 0.20 |
| Y155F/N260S | 2 | 607 | 682 | 18.4 | 3408 | 3530 | 257 | 0.27 |
| Y284N | 2 | 400 | 478 | 9.0 | 2052 | 2210 | 270 | 0.46 |
| R318Y/E410N | 1 | 428 | 474 | 6.1 | 575 | 686 | 900 | 1.46 |
| R338E/E410N | 2 | 334 | 376 | 6.2 | 718 | 844 | 570 | 1.18 |
| R338E/R403E/E4100N | 5 | 436 ± 24 | 507 ± 29 | 13.4 ± 2.0 | 3052 ± 522 | 3302 ± 656 | 196 ± 49 | 0.31 ± 0.06 |
| D203N/F205T/E240N | 2 | 600 | 679 | 6.8 | 671 | 799 | 1080 | 1.25 |
| D203N/F205T/R338E | 2 | 307 | 419 | 9.3 | 1186 | 1586 | 281 | 0.63 |
| D203N/F205T/R338A | 2 | 317 | 403 | 9.0 | 1063 | 1397 | 327 | 0.72 |
| D203N/F205T/R318Y | 2 | 258 | 286 | 8.7 | 508 | 601 | 732 | 1.91 |
| D203N/F205T/R338E/R403E | 2 | 303 | 419 | 11.3 | 2105 | 2804 | 156 | 0.36 |

TABLE 26-continued

PK properties of FIX variants assessed by ELISA

| Mutation | N | T½β | MRT 0-inf | Cmax/ Dose | AUC/ Dose 0-last | AUC/ Dose 0-inf | Vz | Cl |
|---|---|---|---|---|---|---|---|---|
| K228N/E410N | 2 | 373 | 479 | 6.0 | 721 | 1025 | 522 | 0.98 |
| K228N/R338E | 2 | 248 | 340 | 10.4 | 1403 | 1736 | 207 | 0.58 |
| R318Y/R338E/E410N | 5 | 424 ± 306 | 515 ± 378 | 5.8 ± 1.6 | 645 ± 310 | 774 ± 454 | 778 ± 272 | 1.6 ± 0.73 |
| R318Y/R338E/E410N/D104N/K106S | 2 | 502 | 531 | 8.9 | 2008 | 2041 | 355 | 0.49 |
| R318Y/R338E/E410N/Y155F | 2 | 555 | 584 | 6.5 | 678 | 721 | 1136 | 1.53 |
| K228N/R318Y/E410N | 1 | 304 | 408 | 6.0 | 686 | 906 | 485 | 1.10 |
| R318Y/R338E/R403E/E410N | 5 | 442 ± 22 | 534 ± 28 | 16.4 ± 3.7 | 3902 ± 867 | 4232 ± 996 | 157 ± 38 | 0.25 ± 0.05 |
| A103N/N105S/R318Y/R338E/R403E/E410N | 2 | 421 | 527 | 16.2 | 3605 | 3935 | 157 | 0.26 |
| D104N/K106S/R318Y/R338E/R403E/E410N | 2 | 417 | 517 | 15.1 | 3114 | 3392 | 183 | 0.30 |
| Y155F/R318Y/R338E/R403E/E410N | 2 | 565 | 649 | 12.4 | 3687 | 3772 | 226 | 0.27 |
| R318Y/R338E/R403E/E410N/A103N/N105S/Y155F | 3 | 669 ± 145 | 819 ± 223 | 17.2 ± 2.0 | 5844 ± 1064 | 6204 ± 1393 | 156 ± 8.7 | 0.17 ± 0.04 |
| R318Y/R338E/R403E/E410N/D104N/K106S/Y155F | 2 | 472 | 575 | 14.4 | 5885 | 5967 | 114 | 0.17 |
| D203N/F205T/R318Y/E410N | 1 | 431 | 475 | 8.0 | 637 | 761 | 816 | 1.31 |
| R338L | 2 | 368 | 377 | 11.2 | 1761 | 1861 | 285 | 0.54 |
| K316M | 2 | 527 | 665 | 7.9 | 1846 | 2142 | 356 | 0.47 |
| E239S | 2 | 462 | 542 | 11.3 | 2184 | 2416 | 278 | 0.41 |
| E239A | 2 | 538 | 544 | 13.1 | 1973 | 2209 | 353 | 0.45 |
| E239R | 2 | 431 | 709 | 8.9 | 1668 | 2020 | 307 | 0.50 |
| E239K | 2 | 400 | 370 | 14.4 | 2107 | 2222 | 278 | 0.48 |
| H257F | 2 | 328 | 357 | 10.3 | 1689 | 1820 | 273 | 0.70 |
| H257Y | 2 | 352 | 353 | 13.6 | 1971 | 2063 | 245 | 0.49 |
| H257E | 2 | 491 | 520 | 10.9 | 2185 | 2411 | 294 | 0.42 |
| H257S | 2 | 435 | 511 | 8.2 | 1630 | 1769 | 358 | 0.57 |
| T412A | 2 | 473 | 539 | 7.1 | 1561 | 1756 | 379 | 0.58 |
| T412V | 2 | 579 | 665 | 8.3 | 1258 | 1454 | 565 | 0.69 |
| E410N/T412A | 2 | 461 | 514 | 2.8 | 364 | 398 | 1679 | 2.51 |
| E410N/T412V | 2 | 340 | 390 | 3.7 | 431 | 487 | 906 | 2.27 |
| E410Q | 2 | 276 | 283 | 7.2 | 445 | 484 | 836 | 2.19 |
| E410S | 2 | 310 | 286 | 7.2 | 753 | 775 | 587 | 1.32 |
| E410A | 2 | 363 | 328 | 8.6 | 528 | 554 | 946 | 1.81 |
| E410D | 2 | 348 | 377 | 9.2 | 1473 | 1596 | 320 | 0.63 |
| N346D | 2 | 349 | 395 | 13.3 | 2817 | 2956 | 170 | 0.34 |
| Y155F/N346D | 2 | 472 | 478 | 17.0 | 3934 | 3986 | 176 | 0.26 |
| N346Y | 2 | 329 | 325 | 11.7 | 1246 | 1297 | 365 | 0.77 |
| Y345T | 2 | 359 | 453 | 6.1 | 1124 | 1200 | 438 | 0.85 |
| T343R | 2 | 402 | 504 | 6.5 | 1143 | 1234 | 487 | 0.85 |
| T343E | 2 | 414 | 461 | 12.6 | 1740 | 1877 | 318 | 0.53 |
| T343Q | 2 | 434 | 442 | 9.0 | 1626 | 1737 | 408 | 0.63 |
| F342I | 2 | 400 | 476 | 8.3 | 1133 | 1224 | 491 | 0.88 |
| T343R/Y345T | 2 | 325 | 324 | 9.1 | 1094 | 1130 | 422 | 0.90 |
| R318Y/R338E | 2 | 340 | 313 | 11.2 | 1402 | 1452 | 336 | 0.69 |
| K228N/I251S | 2 | 586 | 657 | 11.3 | 1473 | 1588 | 551 | 0.65 |
| K228N/R318Y/R338E/R403E/E410N | 2 | 476 | 647 | 9.1 | 2400 | 2726 | 261 | 0.37 |
| K228N/R318Y/R338E/R403E/E410N/Y155F | 3 | 615 ± 135 | 750 ± 191 | 18.6 ± 2.1 | 5496 ± 2044 | 5970 ± 2260 | 158 ± 50 | 0.18 ± 0.06 |
| K228N/R318Y/R338E/R403E/E410N/D85N | 2 | 587 | 713 | 24.8 | 6153 | 6725 | 125 | 0.15 |
| I251S/R318Y/R338E/R403E/E410N | 3 | 412 ± 140 | 542 ± 181 | 15.7 ± 4.9 | 2306 ± 884 | 2636 ± 1261 | 242 ± 89 | 0.44 ± 0.17 |
| D104N/K106S/I251S/R318Y/R338E/R403E/E410N | 4 | 687 ± 60 | 874 ± 82 | 17.2 ± 2.2 | 7653 ± 456 | 8127 ± 520 | 122 ± 10 | 0.12 ± 0.01 |
| I251S/R318Y/R338E/R403E/E410N/Y155F | 2 | 492 | 620 | 19.9 | 5704 | 6510 | 110 | 0.15 |
| I251S/R318Y/R338E/E410N | 2 | 591 | 630 | 7.5 | 1245 | 1292 | 664 | 0.78 |
| D104N/K106S/D104N/K106S/I251S/R318Y/R338E/E410N | 2 | 726 | 819 | 16.4 | 1512 | 1612 | 650 | 0.62 |
| K247N/N249S/R318Y/R338E/R403E/E410N | 2 | 637 | 807 | 15.4 | 5283 | 5541 | 170 | 0.18 |
| Y155F/K247N/N249S/R318Y/R338E/R403E/E410N | 2 | 613 | 758 | 13.8 | 5335 | 5549 | 160 | 0.18 |
| A103N/N105S/K247N/N249S/R318Y/R338E/R403E/E410N | 2 | 615 | 783 | 18.6 | 7319 | 7612 | 117 | 0.13 |
| D104N/K106S/K247N/N249S/R318Y/R338E/R403E/E410N | 2 | 626 | 754 | 19.4 | 6332 | 6580 | 140 | 0.15 |
| K228N/N84S/R318Y/R338E/E410N | 2 | 512 | 539 | 18.1 | 1925 | 1967 | 396 | 0.54 |

TABLE 26-continued

PK properties of FIX variants assessed by ELISA

| Mutation | N | T½β | MRT 0-inf | Cmax/ Dose | AUC/ Dose 0-last | AUC/ Dose 0-inf | Vz | Cl |
|---|---|---|---|---|---|---|---|---|
| Y155F/K228N/N84S/R318Y/ R338E/E410N | 2 | 617 | 685 | 8.1 | 1170 | 1221 | 745 | 0.83 |
| R318Y/R338E/R403E/E410S | 2 | 382 | 395 | 14.7 | 2897 | 2971 | 184 | 0.34 |
| R318Y/R338E/E410S | 2 | 356 | 326 | 7.7 | 488 | 511 | 1066 | 2.08 |
| K228N/K247N/N249S | 2 | 662 | 753 | 19.6 | 3390 | 3578 | 268 | 0.28 |
| K228N/K247N/N249S/D104N/ K106S/Y155F | 3 | 781 ± 55 | 939 ± 48 | 18.5 ± 3.8 | 6111 ± 1900 | 6606 ± 1949 | 183 ± 63 | 0.16 ± 0.04 |
| K228N/K247N/N249S/D104N/ K106S | 2 | 758 | 838 | 17.9 | 3792 | 4035 | 271 | 0.25 |
| K228N/K247N/N249S/Y155F | 2 | 549 | 643 | 17.2 | 3002 | 3269 | 246 | 0.31 |
| I251S/R318Y/R338E/R403E/ E410N/Y155F | 3 | 599 ± 89 | 753 ± 121 | 21.7 ± 3.2 | 8567 ± 2834 | 9233 ± 2860 | 96.6 ± 15.4 | 0.11 ± 0.03 |
| R318Y/R338E/R403E/E410N/ T412V | 2 | 424 | 456 | 20.0 | 4730 | 4892 | 124 | 0.20 |
| R318Y/R338E/R403E/E410N/ T412A | 2 | 380 | 439 | 17.5 | 4994 | 5115 | 107 | 0.20 |
| R318Y/R338E/R403E/T412A | 3 | 399 ± 88 | 477 ± 108 | 19.7 ± 0.7 | 4320 ± 2385 | 4505 ± 2357 | 144 ± 48 | 0.27 ± 0.15 |
| R318Y/R3380E/T412A | 2 | 462 | 401 | 13.6 | 1674 | 1691 | 398 | 0.60 |
| N260S/R318Y/R338E/R403E/ E410N | 2 | 583 | 743 | 23.9 | 6821 | 7488 | 111 | 0.13 |
| D104N/K106S/N260S/R318Y/ R338E/R403E/E410N | 2 | 779 | 999 | 17.2 | 7100 | 7728 | 145 | 0.12 |
| Y155F/N260S/R318Y/R338E/ R403E/E410N | 2 | 628 | 758 | 21.4 | 5214 | 5465 | 167 | 0.21 |
| R318Y/R338E/N346D/R403E/ E410N | 2 | 474 | 575 | 25.2 | 7623 | 8140 | 86 | 0.12 |
| Y155F/R318Y/R338E/N346D/ R403E/E410N | 2 | 540 | 641 | 18.2 | 5039 | 5172 | 154 | 0.20 |
| K247N/N249S/N260S | 2 | 549 | 632 | 17.4 | 4156 | 4262 | 186 | 0.23 |
| Y155F/K247N/N249S/N260S | 2 | 691 | 814 | 24.0 | 3857 | 4085 | 244 | 0.22 |
| D104N/K106S/K247N/N249S/ N260S | 2 | 712 | 859 | 16.5 | 4187 | 4458 | 235 | 0.23 |
| D104N/K106S/Y155F/K247N/ N249S/N260S | 2 | 680 | 856 | 23.3 | 7026 | 7423 | 134 | 0.14 |
| K247N/N249S/N260S/R318Y/ R338E/R403E/E410N | 2 | 691 | 875 | 18.9 | 6353 | 6737 | 149 | 0.13 |
| R318Y/R338E/T343R/R403E/ E410N | 2 | 531 | 560 | 20.5 | 3766 | 3862 | 200 | 0.27 |
| R338E/T343R | 2 | 534 | 453 | 12.8 | 798 | 813 | 949 | 1.23 |

*80% glycosylated form of E410N

TABLE 27

PK properties of FIX variants assessed by ELISA

| Mutation (Mature FIX Numbering) | Mutation (Chymotrypsin Numbering) | N | Terminal T½ | AUC/ Dose (0-last) | AUC/ Dose (0-inf) | MRT (0-inf) | Cmax/ Dose | Vz | Cl |
|---|---|---|---|---|---|---|---|---|---|
| N157D | N[157]D | 2 | 290 | 1166 | 1211 | 265 | 9.9 | 393 | 0.93 |
| Y155F | Y[155]F | 2 | 443 | 3941 | 4375 | 567 | 18.1 | 149 | 0.23 |
| A103N/N105S/ Y155F | A[103]N/N[105]S/ Y[155]F | 2 | 562 | 2427 | 2496 | 619 | 13.1 | 325 | 0.40 |
| D104N/K106S/ Y155F | D[104]N/K[106]S/ Y[155]F | 3 | 514 ± 79.8 | 3060 ± 1030 | 3180 ± 989 | 581 ± 81.0 | 13.8 ± 1.02 | 243 ± 47.4 | 0.341 ± 0.128 |
| WT | Catalyst Biosciences WT | 2 | 329 | 2036 | 2121 | 360 | 11.9 | 229 | 0.48 |
| A103N/N105S | A[103]N/N[105]S | 2 | 375 | 2841 | 3068 | 481 | 12.5 | 177 | 0.33 |
| D104N/K106S | D[104]N/K[106]S | 2 | 428 | 3379 | 3786 | 558 | 13.9 | 164 | 0.26 |
| K106N/V108S | K[106]N/V[108]S | 2 | 510 | 2748 | 3202 | 629 | 12.8 | 234 | 0.32 |
| D85N | D[85]N | 4 | 575 ± 89.3 | 1530 ± 321 | 1680 ± 83.3 | 623 ± 83.3 | 9.10 ± 0.518 | 528 ± 184 | 0.619 ± 0.156 |
| T148A | BeneFIX, T[148]A | 3 | 314 ± 128 | 1300 ± 298 | 1520 ± 158 | 366 ± 105 | 9.12 ± 1.52 | 308 ± 160 | 0.662 ± 0.071 |
| T148A | T[148]A | 8 | 383 ± 109 | 1620 ± 195 | 1750 ± 234 | 435 ± 128 | 10.2 ± 2.09 | 317 ± 82.3 | 0.582 ± 0.084 |
| K5A | K[5]A | 2 | 271 | 1548 | 1583 | 311 | 10.5 | 251 | 0.64 |
| D64N | D[64]N | 2 | 447 | 1933 | 2152 | 519 | 11.8 | 304 | 0.47 |
| D64A | D[64]A | 2 | 364 | 1351 | 1466 | 372 | 11.5 | 359 | 0.68 |
| N167D | N[167]D | 2 | 334 | 1129 | 1176 | 318 | 8.9 | 410 | 0.85 |
| N167Q | N[167]Q | 3 | 337 ± 8.75 | 1500 ± 258 | 1550 ± 268 | 323 ± 4.25 | 8.20 ± 1.17 | 318 ± 42.5 | 0.655 ± 0.103 |
| S61A | S[61]A | 2 | 397 | 1685 | 1800 | 412 | 10.0 | 325 | 0.57 |
| S53A | S[53]A | 2 | 382 | 2146 | 2321 | 462 | 11.2 | 238 | 0.43 |

TABLE 27-continued

PK properties of FIX variants assessed by ELISA

| Mutation (Mature FIX Numbering) | Mutation (Chymotrypsin Numbering) | N | Terminal T½ | AUC/ Dose (0-last) | AUC/ Dose (0-inf) | MRT (0-inf) | Cmax/ Dose | Vz | Cl |
|---|---|---|---|---|---|---|---|---|---|
| T159A | T[159]A | 2 | 232 | 1036 | 1048 | 227 | 10.5 | 315 | 0.97 |
| T169A | T[169]A | 2 | 348 | 836 | 889 | 319 | 8.3 | 567 | 1.15 |
| T172A | T[172]A | 3 | 494 ± 187 | 2050 ± 408 | 237 ± 676 | 571 ± 214 | 11.2 ± 2.89 | 295 ± 31.5 | 0.447 ± 0.132 |
| T179A | T[179]A | 2 | 377 | 2291 | 2458 | 431 | 12.5 | 223 | 0.42 |
| Y155H | Y[155]H | 2 | 465 | 2365 | 2638 | 552 | 11.6 | 253 | 0.38 |
| Y155Q | Y[155]Q | 1 | 552 | 2583 | 3045 | 645 | 13.6 | 262 | 0.33 |
| S158E | S[158]E | 2 | 433 | 2029 | 2222 | 471 | 14.5 | 291 | 0.46 |
| N157Q | N[157]Q | 2 | 335 | 1185 | 1238 | 352 | 11.3 | 395 | 0.83 |
| D203N/F205T | D39N/F41T | 3 | 481 ± 69.0 | 2030 ± 448 | 2290 ± 489 | 566 ± 28.6 | 9.43 ± 1.93 | 314 ± 91.3 | 0.449 ± 0.087 |
| D85N/D203N/F205T | D[85]N/D39N/F41T | 1 | 291 | 1538 | 2044 | 406 | 12.4 | 205 | 0.49 |
| K228N | K63N | 3 | 490 ± 57.8 | 2340 ± 519 | 2570 ± 682 | 570 ± 27.9 | 12.3 ± 1.58 | 296 ± 119 | 0.410 ± 0.118 |
| A103N/N105S/K228N | A[103]N/N[105]S/K63N | 2 | 583 | 3032 | 3301 | 701 | 14.4 | 255 | 0.30 |
| D104N/K106S/K228N | D[104]N/K[106]S/K63N | 2 | 801 | 2050 | 2238 | 913 | 13.6 | 513 | 0.45 |
| Y155F/K228N | Y[155]F/K63N | 2 | 626 | 2073 | 2149 | 679 | 8.6 | 431 | 0.47 |
| D104N/K106S/Y155F/K228N | D[104]N/K[106]S/Y[155]F/K63N | 2 | 551 | 3730 | 3822 | 614 | 14.0 | 211 | 0.27 |
| I251S | I86S | 2 | 565 | 2646 | 3137 | 718 | 10.1 | 260 | 0.32 |
| A103N/N105S/I251S | A[103]N/N[105]S/I86S | 2 | 444 | 2445 | 2719 | 542 | 14.3 | 241 | 0.38 |
| D104N/K106S/I251S | D[104]N/K[106]S/I86S | 2 | 692 | 2533 | 2664 | 802 | 13.9 | 375 | 0.38 |
| Y155F/I251S | Y[155]F/I86S | 2 | 572 | 2591 | 2790 | 660 | 12.2 | 291 | 0.37 |
| A262S | A95bS | 2 | 373 | 2716 | 2926 | 453 | 14.4 | 188 | 0.36 |
| E410N | E240N | 2 | 439 | 893 | 1365 | 551 | 7.4 | 469 | 0.75 |
| E239N | E74N | 2 | 338 | 1657 | 1908 | 416 | 10.7 | 257 | 0.54 |
| K247N/N249S | K82N/N84S | 6 | 627 ± 174 | 2200 ± 737 | 2540 ± 795 | 734 ± 244 | 10.8 ± 3.41 | 387 ± 154 | 0.420 ± 0.106 |
| Y155F/K247N/N249S | Y[155]F/K82N/N84S | 2 | 538 | 1752 | 1880 | 608 | 10.6 | 420 | 0.53 |
| A103N/N105S/K247N/N249S | A[103]N/N[105]S/K82N/N84S | 2 | 736 | 4369 | 4699 | 852 | 21.5 | 226 | 0.21 |
| D104N/K106S/K247N/N249S | D[104]N/K[106]S/K82N/N84S | 2 | 571 | 2052 | 2109 | 632 | 16.2 | 426 | 0.51 |
| D104N/K106S/Y155F/K247N/N249S | D[104]N/K[106]S/Y[155]F/K82N/N84S | 2 | 603 | 3744 | 3889 | 714 | 16.8 | 233 | 0.27 |
| S319N/L321S | S151N/L153S | 2 | 351 | 2270 | 2409 | 427 | 11.4 | 210 | 0.42 |
| N260S | N95S | 3 | 496 ± 157 | 3360 ± 1300 | 3690 ± 1460 | 619 ± 170 | 11.5 ± 3.18 | 231 ± 156 | 0.295 ± 0.105 |
| D104N/K106S/N260S | D[104]N/K[106]S/N95S | 2 | 805 | 4736 | 5248 | 1001 | 16.1 | 220 | 0.20 |
| Y155F/N260S | Y[155]F/N95S | 2 | 607 | 3408 | 3530 | 682 | 18.4 | 257 | 0.27 |
| Y284N | Y117N | 2 | 400 | 2052 | 2210 | 478 | 9.0 | 270 | 0.46 |
| R318Y/E410N | R150Y/E240N | 1 | 428 | 575 | 686 | 474 | 6.1 | 900 | 1.46 |
| R338E/E410N | R170E/E240N | 2 | 334 | 718 | 844 | 376 | 6.2 | 570 | 1.18 |
| R338E/R403E/E410N | R170E/R233E/E240N | 5 | 436 ± 24.4 | 3050 ± 522 | 3300 ± 656 | 507 ± 28.9 | 13.4 ± 2.03 | 196 ± 49.2 | 0.312 ± 0.063 |
| D203N/F205T/E410N | D39N/F41T/E240N | 2 | 600 | 671 | 799 | 679 | 6.8 | 1080 | 1.25 |
| D203N/F205T/R338E | D39N/F41T/R170E | 2 | 307 | 1186 | 1586 | 419 | 9.3 | 281 | 0.63 |
| D203N/F205T/R338A | D39N/F41T/R170A | 2 | 317 | 1063 | 1397 | 403 | 9.0 | 327 | 0.72 |
| D203N/F205T/R318Y | D39N/F41T/R150Y | 2 | 258 | 508 | 601 | 286 | 8.7 | 732 | 1.91 |
| D203N/F205T/R338E/R403E | D39N/F41T/R170E/R233E | 2 | 303 | 2105 | 2804 | 419 | 11.3 | 156 | 0.36 |
| K228N/E410N | K63N/E240N | 2 | 373 | 721 | 1025 | 479 | 6.0 | 522 | 0.98 |
| K228N/R338E | K63N/R170E | 2 | 248 | 1403 | 1736 | 340 | 10.4 | 207 | 0.58 |
| R318Y/R338E/E410N | R150Y/E240N/R170E | 5 | 424 ± 306 | 645 ± 310 | 774 ± 454 | 515 ± 378 | 5.78 ± 1.56 | 778 ± 272 | 1.62 ± 0.730 |
| D104N/K106S/R318Y/R338E/E410N | D[104]N/K[106]S/R150Y/R170E/E240N/ | 2 | 502 | 2008 | 2041 | 531 | 8.9 | 355 | 0.49 |
| Y155F/R318Y/R338E/E410N | Y[155]F/R150Y/R170E/E240N | 2 | 555 | 678 | 721 | 584 | 6.5 | 1136 | 1.53 |
| K228N/R318Y/E410N | K63N/R150Y/E240N | 1 | 304 | 686 | 906 | 408 | 6.0 | 485 | 1.10 |
| R318Y/R338E/R403E/E410N | R150Y/R170E/R233E/E240N | 5 | 442 ± 22.1 | 3900 ± 867 | 4230 ± 996 | 534 ± 28.0 | 16.4 ± 3.72 | 157 ± 38.3 | 0.246 ± 0.051 |
| A103N/N105S/R318Y/R338E/R403E/E410N | A[103]N/N[105]S/R150Y/R170E/R233E/E240N | 2 | 421 | 3605 | 3935 | 527 | 16.2 | 157 | 0.26 |

TABLE 27-continued

PK properties of FIX variants assessed by ELISA

| Mutation (Mature FIX Numbering) | Mutation (Chymotrypsin Numbering) | N | Terminal T½ | AUC/Dose (0-last) | AUC/Dose (0-inf) | MRT (0-inf) | Cmax/Dose | Vz | Cl |
|---|---|---|---|---|---|---|---|---|---|
| D104N/K106S/R318Y/R338E/R403E/E410N | D[104]N/K[106]S/R150Y/R170E/R233E/E240N | 2 | 417 | 3114 | 3392 | 517 | 15.1 | 183 | 0.30 |
| Y155F/R318Y/R338E/R403E/E410N | Y[155]F/R150Y/R170E/R233E/E240N | 2 | 565 | 3687 | 3772 | 649 | 12.4 | 226 | 0.27 |
| A103N/N105S/Y155F/R318Y/R338E/R403E/E410N | A[103]N/N[105]S/Y[155]F/R150Y/R170E/R233E/E240N | 3 | 669 ± 145 | 5840 ± 1060 | 6200 ± 1390 | 819 ± 223 | 17.2 ± 2.02 | 156 ± 8.74 | 0.167 ± 0.039 |
| D104N/K106S/Y155F/R318Y/R338E/R403E/E410N | D[104]N/K[106]S/Y[155]F/R150Y/R170E/R233E/E240N | 2 | 472 | 5885 | 5967 | 575 | 14.4 | 114 | 0.17 |
| D203N/F205T/R318Y/E410N | D39N/F41T/R150Y/E240N | 1 | 431 | 637 | 761 | 475 | 8.0 | 816 | 1.31 |
| R338L | R170L | 2 | 368 | 1761 | 1861 | 377 | 11.2 | 285 | 0.54 |
| K316M | K148M | 2 | 527 | 1846 | 2142 | 665 | 7.9 | 356 | 0.47 |
| E239S | E74S | 2 | 462 | 2184 | 2416 | 542 | 11.3 | 278 | 0.41 |
| E239A | E74A | 2 | 538 | 1973 | 2209 | 544 | 13.1 | 353 | 0.45 |
| E239R | E74R | 2 | 431 | 1668 | 2020 | 709 | 8.9 | 307 | 0.50 |
| E239K | E74K | 2 | 400 | 2107 | 2222 | 370 | 14.4 | 278 | 0.48 |
| H257F | H92F | 2 | 328 | 1689 | 1820 | 357 | 10.3 | 273 | 0.70 |
| H257Y | H92Y | 2 | 352 | 1971 | 2063 | 353 | 13.6 | 245 | 0.49 |
| H257E | H92E | 2 | 491 | 2185 | 2411 | 520 | 10.9 | 294 | 0.42 |
| H257S | H92S | 2 | 435 | 1630 | 1769 | 511 | 8.2 | 358 | 0.57 |
| T412A | T242A | 2 | 473 | 1561 | 1756 | 539 | 7.1 | 379 | 0.58 |
| T412V | T242V | 2 | 579 | 1258 | 1454 | 665 | 8.3 | 565 | 0.69 |
| E410N/T412A | E240N/T242A | 2 | 461 | 364 | 398 | 514 | 2.8 | 1679 | 2.51 |
| E410N/T412V | E240N/T242V | 2 | 340 | 431 | 487 | 390 | 3.7 | 906 | 2.27 |
| E410Q | E240Q | 2 | 276 | 445 | 484 | 283 | 7.2 | 836 | 2.19 |
| E410S | E240S | 2 | 310 | 753 | 775 | 286 | 7.2 | 587 | 1.32 |
| E410A | E240A | 2 | 363 | 528 | 554 | 328 | 8.6 | 946 | 1.81 |
| E410D | E240D | 2 | 348 | 1473 | 1596 | 377 | 9.2 | 320 | 0.63 |
| N346D | N178D | 2 | 349 | 2817 | 2956 | 395 | 13.3 | 170 | 0.34 |
| Y155F/N346D | 178D/Y[155]F | 2 | 472 | 3934 | 3986 | 478 | 17.0 | 176 | 0.26 |
| N346Y | N178Y | 2 | 329 | 1246 | 1297 | 325 | 11.7 | 365 | 0.77 |
| Y345T | Y177T | 2 | 359 | 1124 | 1200 | 453 | 6.1 | 438 | 0.85 |
| T343R | Y175R | 2 | 402 | 1143 | 1234 | 504 | 6.5 | 487 | 0.85 |
| T343E | T175E | 2 | 414 | 1740 | 1877 | 461 | 12.6 | 318 | 0.53 |
| T343Q | Y175Q | 2 | 434 | 1626 | 1737 | 442 | 9.0 | 408 | 0.63 |
| F342I | F174I | 2 | 400 | 1133 | 1224 | 476 | 8.3 | 491 | 0.88 |
| T343R/Y345T | T175R/Y177T | 2 | 325 | 1094 | 1130 | 324 | 9.1 | 422 | 0.90 |
| R318Y/R338E | R150Y/R170E | 2 | 340 | 1402 | 1452 | 313 | 11.2 | 336 | 0.69 |
| K228N/I251S | K63N/I86S | 2 | 586 | 1473 | 1588 | 657 | 11.3 | 551 | 0.65 |
| K228N/R318Y/R338E/R403E/E410N | K63N/R150Y/R170E/R233E/E240N | 2 | 476 | 2400 | 2726 | 647 | 9.1 | 261 | 0.37 |
| Y155F/K228N/R318Y/R338E/R403E/E410N | Y[155]F/K63N/R150Y/R170E/R233E/E240N | 3 | 615 ± 135 | 5500 ± 2040 | 5970 ± 2260 | 750 ± 191 | 18.6 ± 2.14 | 158 ± 50.1 | 0.183 ± 0.062 |
| D85N/K228N/R318Y/R338E/R403E/E410N | D[85]N/K63N/R150Y/R170E/R233E/E240N | 2 | 587 | 6153 | 6725 | 713 | 24.8 | 125 | 0.15 |
| I251S/R318Y/R338E/R403E/E410N | I86S/R150Y/R170E/R233E/E240N | 3 | 412 ± 140 | 2310 ± 884 | 2640 ± 1260 | 542 ± 181 | 15.7 ± 4.89 | 242 ± 89.4 | 0.438 ± 0.171 |
| D104N/K106S/I251S/R318Y/R338E/R403E/E410N | D[104]N/K[106]S/I86S/R150Y/R170E/R233E/E240N | 4 | 687 ± 60.2 | 7650 ± 456 | 8130 ± 520 | 874 ± 81.7 | 17.2 ± 2.24 | 122 ± 10.1 | 0.123 ± 0.008 |
| Y155F/I251S/R318Y/R338E/R403E/E410N | Y[155]F/I86S/R150Y/R170E/R233E/E240N | 2 | 492 | 5704 | 6510 | 620 | 19.9 | 110 | 0.15 |
| I251S/R318Y/R338E/E410N | I86S/R150Y/R170E/E240N | 2 | 591 | 1245 | 1292 | 630 | 7.5 | 664 | 0.78 |
| D104N/K106S/I251S/R318Y/R338E/E410N | D[104]N/K[106]S/I86S/R150Y/R170E/E240N | 2 | 726 | 1512 | 1612 | 819 | 16.4 | 650 | 0.62 |
| K247N/N249S/R318Y/R338E/R403E/E410N | K82N/N84S/R150Y/R170E/R233E/E240N | 2 | 637 | 5283 | 5541 | 807 | 15.4 | 170 | 0.18 |

TABLE 27-continued

PK properties of FIX variants assessed by ELISA

| Mutation (Mature FIX Numbering) | Mutation (Chymotrypsin Numbering) | N | Terminal T½ | AUC/ Dose (0-last) | AUC/ Dose (0-inf) | MRT (0-inf) | Cmax/ Dose | Vz | Cl |
|---|---|---|---|---|---|---|---|---|---|
| Y155F/K247N/ N249S/R318Y/ R338E/R403E/ E410N | Y[155]F/ K82N/N84S/ R150Y/R170E/ R233E/E240N | 2 | 613 | 5335 | 5549 | 758 | 13.8 | 160 | 0.18 |
| A103N/N105S/ K247N/N249S/ R318Y/R338E/ R403E/E410N | A[103]N/N[105]S K82N/N84S/ R150Y/R170E/ R233E/E240N/ | 2 | 615 | 7319 | 7612 | 783 | 18.6 | 117 | 0.13 |
| D104N/K106S/ K247N/N249S/ R318Y/R338E/ R403E/E410N | D[104]N/K[106]S K82N/N84S/ R150Y/R170E/ R233E/E240N/ | 2 | 626 | 6332 | 6580 | 754 | 19.4 | 140 | 0.15 |
| D104N/K106S/ Y155F/K247N/ N249S/R318Y/ R338E/R403E/ E410N | D[104]N/K[106]S/ Y[155]F/K82N/ N84S/R150Y/ R170E/R233E/ E240N | 2 | 846 | 8069 | 8807 | 1020 | 18.4 | 139 | 0.11 |
| K247N/N249S/ R318Y/R338E/ E410N | K82N/N84S/ R150Y/R170E/ E240N | 2 | 512 | 1925 | 1967 | 539 | 18.1 | 396 | 0.54 |
| Y155F/K247N/ N249S/R318Y/ R338E/E410N | Y[155]F/ K82N/N84S/ R150Y/R170E/ E240N/ | 2 | 617 | 1170 | 1221 | 685 | 8.1 | 745 | 0.83 |
| R318Y/R338E/ R403E/E410S | R150Y/R170E/ R233E/E240S | 2 | 382 | 2897 | 2971 | 395 | 14.7 | 184 | 0.34 |
| R318Y/R338E/ E410S | R150Y/R170E/ E240S | 2 | 356 | 488 | 511 | 326 | 7.7 | 1066 | 2.08 |
| K228N/K247N/ N249S | K63N/K82N/ N84S | 2 | 662 | 3390 | 3578 | 753 | 19.6 | 268 | 0.28 |
| D104N/K106S/ Y155F/K228N/ K247N/N249S | D[104]N/K[106]S/ Y[155]F/K63N/ K82N/N84S | 3 | 781 ± 55.2 | 6110 ± 1900 | 6610 ± 1950 | 939 ± 48.2 | 18.5 ± 3.84 | 183 ± 63.3 | 0.160 ± 0.045 |
| D104N/K106S/ K228N/K247N/ N249S | D[104]N/K[106]S/ K63N/K82N/ N84S | 2 | 758 | 3792 | 4035 | 838 | 17.9 | 271 | 0.25 |
| Y155F/K228N/ K247N/N249S | Y[155]F/K63N/ K82N/N84S | 2 | 549 | 3002 | 3269 | 643 | 17.2 | 246 | 0.31 |
| K228N/K247N/ N249S/R318Y/ R338E/R403E/ E410N | Y[155]F/I86S/ R150Y/R170E/ R233E/E240N/ | 3 | 599 ± 88.6 | 8570 ± 2830 | 9230 ± 2860 | 753 ± 120 | 21.7 ± 3.19 | 96.6 ± 15.4 | 0.115 ± 0.030 |
| D104N/K106S/ K228N/K247N/ N249S/R318Y/ R338E/R403E/ E410N | D[104]N/K[106]S/ K63N/K82N/ N84S/R150Y/ R170E/R233E/ E240N | 3 | 806 ± 88.6 | 9330 ± 2830 | 9990 ± 2860 | 912 ± 120 | 24.4 ± 3.19 | 116 ± 15.4 | 0.100 ± 0.030 |
| Y155F/K228N/ K247N/N249S/ R318Y/R338E/ R403E/E410N | Y[155]F/K63N/ K82N/N84S/ R150Y/R170E/ R233E/E240N | 1 | 559 | 10704 | 11042 | 710 | 27.3 | 73 | 0.09 |
| R318Y/R338E/ R403E/E410N/ T412V | R150Y/R170E/ R233E/E240N/ T242V | 2 | 424 | 4730 | 4892 | 456 | 20.0 | 124 | 0.20 |
| R318Y/R338E/ R403E/E410N/ T412A | R150Y/R170E/ R233E/E240N/ T242A | 2 | 380 | 4994 | 5115 | 439 | 17.5 | 107 | 0.20 |
| R318Y/R338E/ R403E/T412A | R150Y/R170E/ R233E/T242A | 3 | 399 ± 88.1 | 4320 ± 2380 | 4500 ± 2360 | 477 ± 108 | 19.7 ± 0.684 | 144 ± 47.8 | 0.270 ± 0.145 |
| R318Y/R338E/ T412A | R150Y/R170E/ T242A | 2 | 462 | 1674 | 1691 | 401 | 13.6 | 398 | 0.60 |
| R318Y/R338E/ E410N/T412V | 150Y/R170E/ E240N/T242V | 2 | 251 | 524 | 555 | 226 | 16.3 | 772 | 2.31 |
| N260S/R318Y/ R338E/R403E/ E410N | N95S/R150Y/ R170E/R233E/ E240N | 2 | 583 | 6821 | 7488 | 743 | 23.9 | 111 | 0.13 |
| D104N/K106S/ N260S/R318Y/ R338E/R403E/ E410N | D[104]N/K[106]S/ N95S/R150Y/ R170E/R233E/ E240N | 2 | 779 | 7100 | 7728 | 999 | 17.2 | 145 | 0.12 |
| Y155F/N260S/ R318Y/R338E/ R403E/E410N | Y[155]F/N95S/ R150Y/R170E/ R233E/E240N | 2 | 628 | 5214 | 5465 | 758 | 21.4 | 167 | 0.21 |

TABLE 27-continued

PK properties of FIX variants assessed by ELISA

| Mutation (Mature FIX Numbering) | Mutation (Chymotrypsin Numbering) | N | Terminal T½ | AUC/ Dose (0-last) | AUC/ Dose (0-inf) | MRT (0-inf) | Cmax/ Dose | Vz | Cl |
|---|---|---|---|---|---|---|---|---|---|
| R318Y/R338E/ N346D/R403E/ E410N | R150Y/R170E/ N178D/R233E/ E240N | 2 | 474 | 7623 | 8140 | 575 | 25.2 | 86 | 0.12 |
| Y155F/R318Y/ R338E/N346D/ R403E/E410N | Y[155]F/R150Y/ R170E/N178D/ R233E/E240N | 2 | 540 | 5039 | 5172 | 641 | 18.2 | 154 | 0.20 |
| K247N/N249S/ N260S | K82N/N84S/ N95S | 2 | 549 | 4156 | 4262 | 632 | 17.4 | 186 | 0.23 |
| Y155F/K247N/ N249S/N260S | Y[155]F/K82N/ N84S/N95S | 2 | 691 | 3857 | 4085 | 814 | 24.0 | 244 | 0.22 |
| D104N/K106S/ K247N/N249S/ N260S | D[104]N/K[106]S/ K82N/N84S/ N95S | 2 | 712 | 4187 | 4458 | 859 | 16.5 | 235 | 0.23 |
| D104N/K106S/ Y155F/K247N/ N249S/N260S | D[104]N/K[106]S/ Y[155]F/K82N/ N84S/N95S/ | 2 | 680 | 7026 | 7423 | 856 | 23.3 | 134 | 0.14 |
| K247N/N249S/ N260S/R318Y/ R338E/R403E/ E410N | K82N/N84S/ N95S/R150Y/ R170E/R233E/ E240N | 2 | 691 | 6353 | 6737 | 875 | 18.9 | 149 | 0.13 |
| Y155F/K247N/ N249S/N260S/ R318Y/R338E/ R403E/E410N | Y[155]F/K82N/ N84S/N95S/ R150Y/R170E/ R233E/E240N | 1 | 1038 | 8401 | 9376 | 1068 | 21.0 | 160 | 0.11 |
| R318Y/R338E/ T343R/R403E/ E410N | T175R/R233E/ E240N/R150Y/ R170E | 2 | 531 | 3766 | 3862 | 560 | 20.5 | 200 | 0.27 |
| Y155F/R318Y/ R338E/T343R/ R403E/E410N | Y[155]F/R150Y/ R170E/T175R/ R233E/E240N | 1 | 182 | 3223 | 4335 | 259 | 20.5 | 61 | 0.23 |
| D104N/K106S/ R318Y/R338E/ T343R/R403E/ E410N | D[104]N/K[106]S/ R150Y/R170E/ T175R/R233E/ E240N | 3 | 666 ± 89.9 | 7270 ± 729 | 7550 ± 708 | 699 ± 88.0 | 21.7 ± 4.71 | 128 ± 21.1 | 0.133 ± 0.013 |
| R338E/T343R | R170E/T175R | 2 | 534 | 798 | 813 | 453 | 12.8 | 949 | 1.23 |
| T343R/N346Y | T175R/N178Y | 3 | 276 ± 19.9 | 1080 ± 331 | 1100 ± 333 | 228 ± 7.76 | 12.3 ± 5.14 | 394 ± 156 | 0.989 ± 0.360 |
| R318Y/R338E/ N346Y/R403E/ E410N | R150Y/R170E/ N178Y/R233E/ E240N | 2 | 324 | 2394 | 2487 | 335 | 24.7 | 189 | 0.40 |
| R318Y/R338E/ T343R/N346Y/ R403E/E410N | R150Y/R170E/ T175R/N178Y/ R233E/E240N | 2 | 303 | 3569 | 3691 | 329 | 22.2 | 118 | 0.27 |
| T343R/N346D | T175R/N178D | 2 | 388 | 2903 | 2917 | 356 | 17.0 | 192 | 0.34 |
| R318Y/R338E/ T343R/N346D/ R403E/E410N | R150Y/R170E/ T175R/N178D/ R233E/E240N | 2 | 450 | 6645 | 6717 | 506 | 20.7 | 97 | 0.15 |
| R318Y/R338E/ Y345A/R403E/ E410N | R150Y/R170E/ Y177A/R233E/ E240N | 1 | 475 | 4989 | 5058 | 511 | 22.3 | 135 | 0.20 |
| R318Y/R338E/ Y345A/N346D/ R403E/E410N | R150Y/R170E/ Y177A/N178D/ R233E/E240N | 2 | 492 | 6249 | 6347 | 607 | 22.1 | 112 | 0.16 |
| Y155F/K247N/ N249S/R318Y/ R338E/R403E | Y[155]F/K82N/ N84S/R150Y/ R170E/R233E | 2 | 622 | 10477 | 10973 | 791 | 26.9 | 85 | 0.10 |
| K247N/N249S/ R318Y/R338E/ R403E | K82N/N84S/ R150Y/R170E/ R233E | 2 | 805 | 8099 | 8569 | 814 | 20.0 | 137 | 0.12 |
| Y155F/K247N/ N249S/R338E/ R403E/E410N | Y[155]F/K82N/ N84S/R170E/ R233E/E240N | 2 | 618 | 9233 | 9709 | 801 | 22.4 | 92 | 0.10 |
| R318Y/R338E/ T343R/R403E | R150Y/R170E/ T175R/R233E | 2 | 421 | 6107 | 6153 | 473 | 19.9 | 99 | 0.16 |
| R318Y/R338E/ T343R/E410N | R150Y/R170E/ T175R/E240N | 2 | 529 | 793 | 815 | 391 | 5.6 | 931 | 1.23 |
| R150Y/T343R/ R403E/E410N | R150Y/T175R/ R233E/E240N | 2 | 431 | 5020 | 5060 | 434 | 20.7 | 130 | 0.21 |
| R170E/T343R/ R403E/E410N | R170E/T175R/ R233E/E240N | 2 | 484 | 5008 | 5060 | 450 | 19.8 | 141 | 0.20 |
| Y155F/R338E/ T343R/R403E/ E410N | Y[155]F/R170E/ T175R/R233E/ E240N | 2 | 628 | 5406 | 5509 | 521 | 17.9 | 164 | 0.18 |

TABLE 27-continued

PK properties of FIX variants assessed by ELISA

| Mutation (Mature FIX Numbering) | Mutation (Chymotrypsin Numbering) | N | Terminal T½ | AUC/Dose (0-last) | AUC/Dose (0-inf) | MRT (0-inf) | Cmax/Dose | Vz | Cl |
|---|---|---|---|---|---|---|---|---|---|
| Y155F/K247N/N249S/R318Y/R338E/T343R/R403E/E410N | K82N/N84S/R150Y/R170E/T175R/R233E/E240N | 2 | 513 | 9067 | 9267 | 642 | 24.7 | 82 | 0.11 |
| K247N/N249S/R318Y/R338E/T343R/R403E/E410N | K82N/N84S/R150Y/R170E/T175R/R233E/E240N | 2 | 536 | 8604 | 8824 | 672 | 24.4 | 89 | 0.12 |
| Y155F/K228N/I251S/R318Y/R338E/R403E/E410N | Y[155]F/K63N/I86S/R150Y/R170E/R233E/E240N | 2 | 780 | 9033 | 9557 | 854 | 20.5 | 123 | 0.11 |
| N260S/R318Y/R338E/T343R/R403E/E410N | Y[155]F/N95S/R150Y/R170E/T175R/R233E/E240N | 2 | 539 | 8325 | 8537 | 675 | 24.0 | 92 | 0.12 |
| Y155F/N260S/R318Y/R338E/T343R/R403E/E410N | Y[155]F/N95S/R150Y/R170E/T175R/R233E/E240N | 1 | 578 | 3266 | 6295 | 733 | 20.4 | 133 | 0.16 |
| K228N/K247N/N249S/R318Y/R338E/T343R/R403E/E410N | K63N/K82N/N84S/R150Y/R170E/T175R/R233E/E240N | 2 | 753 | 8972 | 9391 | 757 | 26.0 | 117 | 0.11 |
| Y155F/R338E/T343R/R403E | Y[155]F/R170E/T175R/R233E | 2 | 503 | 5350 | 5412 | 506 | 16.7 | 135 | 0.19 |
| Y155F/R338E/T343R/R403E/E410S | Y[155]F/R170E/T175R/R233E/E240S | 2 | 589 | 5447 | 5546 | 526 | 22.9 | 156 | 0.18 |
| Y155F/N260S/R338E/T343R/R403E | Y[155]F/N95S/R170E/T175R/R233E | 2 | 485 | 9590 | 9749 | 619 | 24.0 | 74 | 0.10 |
| Y155F/I251S/R338E/T343R/R403E | Y[155]F/I86S/R170E/T175R/R233E | 2 | 732 | 7531 | 7926 | 807 | 21.0 | 134 | 0.13 |
| R318Y/R338E/T343R/R403E/E410S | R150Y/R170E/T175R/R233E/E240S | 2 | 618 | 4657 | 4728 | 466 | 19.9 | 199 | 0.23 |
| Y155F/K247N/N249S/T343R/R403E | Y[155]F/K82N/N84S/T175R/R233E | 2 | 866 | 7007 | 7391 | 751 | 18.3 | 169 | 0.14 |
| K247N/N249S/R338E/T343R/R403E/E410N | K82N/N84S/R170E/T175R/R233E/E240N | 2 | 804 | 9554 | 10051 | 776 | 20.4 | 116 | 0.10 |
| Y155F/K247N/N249S/R318Y/R338E | Y[155]F/K82N/N84S/R150Y/R170E | 2 | 662 | 2965 | 3048 | 578 | 13.6 | 313 | 0.33 |
| Y155F/K247N/N249S/R338E/R403E | Y[155]F/K82N/N84S/R170E/R233E | 1 | 717 | 8404 | 8790 | 783 | 16.9 | 118 | 0.11 |
| Y155F/K247N/N249S/R338E/T343R/R403E | Y[155]F/K82N/N84S/R170E/T175R/R233E | 2 | 676 | 7455 | 7702 | 676 | 20.3 | 131 | 0.13 |
| K247N/N249S/T343R/R403E/E410N | K82N/N84S/T175R/R233E/E240N | 2 | 680 | 7758 | 8085 | 747 | 18.0 | 122 | 0.13 |

Example 7

In Vivo Assessment of Fix Polypeptide Procoagulant Activity

Mouse models of hemophilia B, using mice deficient in FIX (FIX$^{-/-}$ mice), were established to assess the procoagulant activity of FIX polypeptides. The mice were treated with FIX polypeptide and the amount of blood lost in 20 minutes was measured to determine the procoagulant activity of the FIX polypeptides.

A. In Vivo Assessment of Wild-type Fix Procoagulant Activity

Male FIX$^{-/-}$ mice were anesthetized by intraperitoneal administration of a ketamine/xylazine cocktail (45 mg/ml and 3.6 mg/ml in saline) and placed on a heated platform (39° C.) to ensure there was no drop in body temperature. The procedure room was kept at a temperature of 82° F. Ten minutes prior to tail cut the tail was immersed in 10 mL of pre-warmed PBS (15 mL centrifuge tube; 39° C.). Seven to fifteen mice were injected with recombinant human FIX (Benefix® Coagulation Factor IX (Recombinant), Wyeth) or modified FIX polypeptides diluted in a buffer that was the same as that of Benefix® Coagulation Factor IX (Recombinant) (0.234% sodium chloride, 8 mM L-histidine, 0.8% sucrose, 208 mM glycine, 0.004% polysorbate 80) via the tail vein in a single injection. A negative control group of mice received buffer only. In instances where the injection was missed, the animal was excluded from the study.

Injection with FIX polypeptide or buffer was made 5 minutes prior to tail cut. The tail cut was made using a razor blade 5 mm from the end of the tail and blood was collected into PBS for a period of 20 minutes. At the end of the collection period, total blood loss was assessed. The collection tubes were mixed and a 1 ml aliquot of each sample was taken and assayed for hemoglobin content. Triton X-100 was diluted 1 in 4 in sterile water and 100 μL was added to the 1 mL samples to cause hemolysis. The absorbance of the samples was then measured at a wavelength of 546 nm. To calculate the amount of blood lost, the absorbance was read against a standard curve generated by measuring the absorbance at 546 nm of known volumes of murine blood, diluted in PBS and hemolyzed as above with Triton X 100. Values are expressed as Mean±SEM.

1. Dose Response Study Assessing Wild-type FIX Coagulant Activity

Dose response studies to assess the coagulant activity of Benefix® Coagulation Factor IX (Recombinant) at 0.03, 0.1, 0.3 and 1 mg/kg in FIX$^{-/-}$ mice were performed. In this experiment, the blood loss in the buffer-only group was 835.42±24.55 μl .which was significantly reduced by Benefix® Coagulation Factor IX (Recombinant) treatment at 0.1, 0.3 and 1 mg/kg (to 558.59±56.63 μL, 415.81±66.724 μL and 270.75±57.48 μL; p<0.05 using Kruskal-Wallis followed by Dunn's post test). At the lowest dose tested of 0.03 mg/kg the value was 731.66±59.16 μL. Calculated $ED_{50}$ values using non-linear regression are shown in Table 28 below.

2. Dose Response Assessing the Coagulant Activity of FIXa-R318Y/R338E/R403E/E410N, FIXa-R318Y/R338E/E410N and FIXa-Y155F/K247N/N249S/R318Y/R338E/R403E/E410N Dose response studies were conducted in which the coagulant activity of FIXa-R318Y/R338E/R403E/E410N(R150Y/R170E/R233E/E240N by chymotrypsin numbering), FIXa-R318Y/R338E/E410N(R150Y/R170E/E240N by chymotrypsin numbering) and FIXa-Y155F/K247N/N249S/R318Y/R338E/R403E/E410N (Y[155]F/K82N/N84S/R150Y/R170E/R233E/E240N by chymotrypsin numbering) at different doses were assessed.

Treatment with FIXa-R318Y/R338E/R403E/E410N resulted in significant inhibition of blood loss at 0.01, 0.03, 0.1, 0.3 and 1 mg/kg (434.65±73.75 μL, 497.28±50.92 μL, 230.81±39.67 μL, 261.94±58.79 μL and 251.56±41.81 μL, respectively) compared to the buffer-only control (811.45±26.63 μL; p<0.05 using Kruskal-Wallis followed by Dunn's post test). Reducing the dose to 0.003 mg/kg led to blood loss values nearer control levels, of 786.83±44.39 μL.

Treatment with FIXa-R318Y/R338E/E410N also resulted in significant inhibition of blood loss at 0.03, 0.1, 0.3 and 1 mg/kg (571.67±50.45 μL, 425.42±43.65 μL, 263.47±42.66 μL and 78.19±13.42 μL, respectively) compared to the buffer-only control (845.14±23.63 μL; p<0.05 using Kruskal-Wallis followed by Dunn's post test). Reducing the dose to 0.001 mg/kg led to blood loss values nearer control levels, of 777.16±53.72 μL.

Treatment with FIXa-Y155F/K247N/N249S/R318Y/R338E/R403E/E410N resulted in the most significant inhibition of blood loss of the mutants tested: 460.03±74.60 μL, 393.48±75.16 μL and 157.28±28.89 μL at 0.01, 0.03 and 0.1 mg/kg, respectively, compared to the buffer-only control (851.38±44.25 μL; p<0.05 using Kruskal-Wallis followed by Dunn's post test). Calculated $ED_{50}$ values using non-linear regression are shown in Table 28 below.

TABLE 28

| Mutation (Mature FIX numbering) | Mutation (chymotrypsin numbering | n/group | n (expts) | Blood Loss; ED50 (mg/kg) |
|---|---|---|---|---|
| BeneFIX Benefix ® Coagulation FIX (T148A) | BeneFIX Benefix ® Coagulation FIX (T[148]A) | 7-20 | 2 | 0.2 |
| R318Y/R338E/R403E/E410N | R150Y/R170E/R233E/E240N | 19-38 | 3 | 0.02 |
| R318Y/R338E/E410N | R150Y/R170E/E240N | 8-42 | 4 | 0.06 |
| Y155F/K247N/N249S/R318Y/R338E/R403E/E410N | Y[155]F/K82N/N84S/R150Y/R170E/R233E/E240N | 18-21 | 2 | 0.01 |

3. Duration Response Assessing Wild-type FIX Coagulant Activity

Studies were performed to assess the duration of effect of Benefix® Coagulation Factor IX (Recombinant) at 0.5 mg/kg in FIX$^{-/-}$ mice. Mice were dosed intravenously at 48 hr, 24 hr, 16 hr, 8 hr, 4 hr, 2 hr, 30 min and 5 min prior to tail cut. In this experiment, inhibition from the control group was determined where the control group was set at 0% inhibition. Inhibition of blood loss was 59.7±11.9%, 48.25±12.84%, 57.74±9.10%, 56.04±8.46%, 32.09±7.92%, 12.94±7.33%, 38.75±11.47% and 0.64±11.3% at 5 min, 30 min, 2, 4, 8, 16, 24 and 48 hr, respectively from vehicle control (Mean and SEM, n=8-33 mice, from 3 experiments).

4. Duration Response Assessing FIXa-R318Y/R338E/R403E/E410N Coagulant Activity

Studies were performed to assess the duration of effect of FIXa-R318Y/R338E/R403E/E410N at 0.5 mg/kg in FIX$^{-/-}$ mice. Mice were dosed i.v. at 96 hr, 72 hr, 48 hr, 32 hr, 24 hr, 16 hr, 8 hr, 4 hr, 2 hr, 30 min and 5 min prior to tail cut. In this experiment, inhibition from the control group was determined where the control group was set at 0% inhibition. Inhibition of blood loss was 93.26±2.04%, 96.30±3.70%, 85.86±6.52%, 69.4±9.92%, 89.05±3.69%, 78.48±8.71%, 63.33±6.70%, 47.97±10.07%, 3.1±8.22%, −13.52±10.59% and −12.82±7.31% at 5 min, 30 min, 2, 4, 8, 16, 24, 32, 48, 72 and 96 hr, respectively from vehicle control (Mean and SEM, n=8-45 mice, from 4 experiments).

Note on the FIX$^{-/-}$ Mice:

The FIX knockout colony of mice was generated by in vitro fertilization using cryo-preserved sperm from male FIX knock out mice. All offspring were genotyped using PCR-based protocols to select those animals that contained a FIX knock-out allele. Further crossings of these animals and their offspring (after PCR-based genotyping) produced FIX knock-out animals (i.e., hemizygous males and homozygous females because the FIX gene is on the X chromosome), as confirmed by PCR. After PCR confirmation of the genotype of all members of this initial FIX colony, PCR confirmation of all colony offspring was ceased since legitimate knock-out animals can only produce knock-out offspring. "Retired breeders" from the colony were, however, genotyped on several occasions. Approximately 7 months after genotyping of all colony offspring was ceased, genotyping of retired breeders clearly indicated the presence of non-knock-out (or wild-type) animals in the colony. Based on this result, all members of the knock-out colony were genotyped and any non-knock-out animals were identified and eliminated from the colony. The results of the colony genotyping indicated that 19% of the male mice were wild type and 4% of the male animals were ambiguous due to poor DNA preparations. Both the wild type and "ambiguous" males (and females) were eliminated from the colony.

Thus, the FIX knockout colony was contaminated at some point with one or more non-knock-out animals and therefore contained a small fraction of non-knock out animals that increased over time until between 19-23% of the males in the colony contained a wild type FIX gene (in vivo experiments use male mice only). With respect to the FIX data generated and reported in this application, all of the in vitro data is unaffected. With respect to in vivo data, it is assumed and expected that the contamination affected all compounds similarly and therefore does not affect either the rank order of variants or their comparison to BeneFIX. Since the contaminating animals already had endogenous FIX, they would lose much less blood in the efficacy and duration experiments than true hemophilic animals and would benefit much less from administration of exogenous FIX, therefore increasing the "spread" or variability of data for all compounds. The contamination also could make all the compounds appear slightly less potent than they actually are, but their ratio to BeneFIX should not be altered (i.e., the potency and duration advantage of our lead molecules should be unaffected).

B. In Vivo Assessment of Wild-Type FIX Procoagulant Activity—New Colony Data

The data described below comes from a new colony, rebuilt from the confirmed FIX −/− mice described above. Mice were double confirmed by genotyping before being used as breeders. All data described below comes from mice born from breeding units where parents have been double confirmed. All replacement breeders are also double confirmed as FIX −/− prior to initiation of new breeding units.

Male $FIX^{-/-}$ mice were anesthetized by intraperitoneal administration of a ketamine/xylazine cocktail (45 mg/ml and 3.6 mg/ml in saline) and placed on a heated platform (39° C.) to ensure there was no drop in body temperature. The procedure room was kept at a temperature of 82° F. Ten minutes prior to tail cut the tail was immersed in 10 mL of pre-warmed PBS (15 mL centrifuge tube; 39° C.). Seven to fifteen mice were injected with recombinant human FIX (Benefix® Coagulation Factor IX (Recombinant), Wyeth) or modified FIX polypeptides diluted in a buffer that was the same as that of Benefix® Coagulation Factor IX (Recombinant) (0.234% sodium chloride, 8 mM L-histidine, 0.8% sucrose, 208 mM glycine, 0.004% polysorbate 80) via the tail vein in a single injection. A negative control group of mice received buffer only. In instances where the injection was missed, the animal was excluded from the study.

Injection with FIX polypeptide or buffer was made 5 minutes prior to tail cut. The tail cut was made using a razor blade 5 mm from the end of the tail and blood was collected into PBS for a period of 20 minutes. At the end of the collection period, total blood loss was assessed. The collection tubes were mixed and a 1 ml aliquot of each sample was taken and assayed for hemoglobin content. Triton X-100 was diluted 1 in 4 in sterile water and 100 was added to the 1 mL samples to cause hemolysis. The absorbance of the samples was then measured at a wavelength of 546 nm. To calculate the amount of blood lost, the absorbance was read against a standard curve generated by measuring the absorbance at 546 nm of known volumes of murine blood, diluted in PBS and hemolyzed as above with Triton X 100. Values are expressed as Mean±SEM.

1. Dose Response Studies Assessing FIX Coagulant Activity

Dose response studies to assess the coagulant activity of Benefix® Coagulation Factor IX (Recombinant) and FIX polypeptides at varying doses in $FIX^{-/-}$ mice were performed. In these experiments $ED_{50}$ values were calculated using non-linear regression and are shown in Table 29 below.

TABLE 29

| | Dose Response $ED_{50}$ values | | | |
|---|---|---|---|---|
| Mutation | Mutation (Chymotrypsin numbering) | n/group/ expt | N (expts) | Average ED50 (mg/kg) |
| BeneFIX | BeneFIX | 10-14 | 2 | 0.4 |
| WT | Catalyst Biosciences WT | 8-15 | 4 | 1.6 |
| T148A | T[148]A | 10-15 | 2 | 1.0 |
| R318Y/R338E/E410N | R150Y/R170E/E240N | 10-13 | 2 | 0.14 |
| R318Y/R403E/E410N | R150Y/R233E/E240N | 13-15 | 2 | 0.095 |
| R318Y/R338E/R403E/E410N | R150Y/R170E/R233E/E240N | 7-14 | 6 | 0.02 |
| D104N/K106S/Y155F/R318Y/ R338E/R403E/E410N | D[104]N/K[106]S/Y[155]F/ R150Y/R170E/R233E/E240N | 9-14 | 4 | 0.05 |
| T343R | T175R | 9-15 | 4 | 0.9 |
| Y155F/K228N/R318Y/R338E/ R403E/E410N | Y[155]F/K63N/R150Y/R170E/ R233E/E240N | 10-14 | 2 | 0.08 |
| I251S/R318Y/R338E/E410N | I86S/R150Y/R170E/E240N | 9-18 | 3 | 1.0 |
| K247N/N249S/R318Y/R338E/ R403E/E410N | K82N/N84S/R150Y/R170E/ R233E/E240N | 9-14 | 4 | 0.06 |
| Y155F/K247N/N249S/R318Y/ R338E/R403E/E410N | Y[155]F/K82N/N84S/R150Y/ R170E/R233E/E240N | 9-15 | 4 | 0.03 |
| A103N/N105S/K247N/N249S/ R318Y/R338E/R403E/E410N | A[103]N/N[105]S/K82N/N84S/ R150Y/R170E/R233E/E240N | 8-10 | 2 | 0.08 |
| D104N/K106S/Y155F/K247N/ N249S/R318Y/R338E/R403E/ E410N | D[104]N/K[106]S/Y[155]F/ K82N/N84S/R150Y/R170E/ R233E/E240N | 12-15 | 2 | 0.055 |
| R318Y/R338E/R403E/E410S | R150Y/R170E/R233E/E240S | 10-15 | 2 | 0.055 |
| D104N/K106S/Y155F/K228N/ K247N/N249S | D[104]N/K[106]S/Y[155]F/ K63N/K82N/N84S | 10-12 | 1 | 1.64 |

TABLE 29-continued

Dose Response ED$_{50}$ values

| Mutation | Mutation (Chymotrypsin numbering) | n/group/ expt | N (expts) | Average ED50 (mg/kg) |
|---|---|---|---|---|
| K228N/K247N/N249S/R318Y/ R338E/R403E/E410N | K63N/K82N/N84S/R150Y/ R170E/R233E/E240N | 8-15 | 5 | 0.08 |
| D104N/K106S/K228N/K247N/ N249S/R318Y/R338E/R403E/ E410N | D[104]N/K[106]S/K63N/K82N/ N84S/R150Y/R170E/R233E/ E240N | 13-15 | 2 | 0.125 |
| Y155F/K228N/K247N/N249S/ R318Y/R338E/R403E/E410N | Y[155]F/K63N/K82N/N84S/ R150Y/R170E/R233E/E240N | 12-15 | 2 | 0.035 |
| R318Y/R338E/R403E/E410N/ T412V | R150Y/R170E/R233E/E240N/ T242V | 8-14 | 3 | 0.03 |
| R318Y/R338E/R403E/E410N/ T412A | R150Y/R170E/R233E/E240N/ T242A | 11-15 | 2 | 0.04 |
| K247N/N249S/N260S/R318Y/ R338E/R403E/E410N | K82N/N84S/N95S/R150Y/ R170E/R233E/E240N | 8-15 | 4

TABLE 29-continued

Dose Response ED$_{50}$ values

| Mutation | Mutation (Chymotrypsin numbering) | n/group/ expt | N (expts) | Average ED50 (mg/kg) |
|---|---|---|---|---|
| K247N/N249S/R338E/T343R/ R403E/E410N | K82N/N84S/R170E/T175R/ R233E/E240N | 10-15 | 2 | 0.18 |
| Y155F/K247N/N249S/R338E/ R403E | Y[155]F/K82N/N84S/R170E/ R233E | 12-15 | 2 | 0.22 |
| Y155F/K247N/N249S/R318Y/ R338E/T343R/E410N | Y[155]F/K82N/N84S/R150Y/ R170E/T175R/E240N | 12-15 | 2 | 0.12 |
| K247N/N249S/R318Y/R338E/ T343R/E410N | K82N/N84S/R150Y/R170E/ T175R/E240N | 11-14 | 2 | 0.12 |
| Y155F/K247N/N249S/R318Y/ T343R/R403E/E410N | Y[155]F/K82N/N84S/R150Y/ T175R/R233E/E240N | 10-15 | 2 | 0.07 |
| K247N/N249S/R318Y/T343R/ R403E/E410N | K82N/N84S/R150Y/T175R/ R233E/E240N | 14-15 | 1 | 0.02 |
| Y155F/K247N/N249S/R318Y/ T343R/R403E | Y[155]F/K82N/N84S/R150Y/ T175R/R233E | 11-14 | 2 | 0.065 |
| Y155F/K247N/N249S/R318Y/ T343R/E410N | Y[155]F/K82N/N84S/R150Y/ T175R/E240N | 12-15 | 1 | 0.25 |
| Y155F/K247N/N249S/R338E/ T343R/R403E | Y[155]F/K82N/N84S/R170E/ T175R/R233E | 10-15 | 2 | 0.125 |
| Y155F/K247N/N249S/T343R/ R403E/E410N | Y[155]F/K82N/N84S/T175R/ R233E/E240N | 13-14 | 1 | 0.1 |
| Y155F/K247N/N249S/R318Y/ R338E/T343R | Y[155]F/K82N/N84S/R150Y/ R170E/T175R | 13-14 | 2 | 0.07 |
| Y155F/K247N/N249S/T343R/ E410N | Y[155]F/K82N/N84S/T175R/ E240N | 11-15 | 1 | 0.11 |

2. Duration Response Assessing Wild-type FIX Coagulant Activity

Studies were performed to assess the duration of effect of Benefix® Coagulation Factor IX (Recombinant) at 0.5 mg/kg in FIX$^{-/-}$ mice. Mice were dosed intravenously at 48 hr, 32 hr, 24 hr, 16 hr, 8 hr, 4 hr, 2 hr and 5 min prior to tail cut. In this experiment, inhibition from the control group was determined where the control group was set at 0% inhibition. Inhibition of blood loss was 68.6±5.8%, 64±6.98%, 54.7±6.13%, 43.4±6.86%, 13.7±5.53%, 24.9±6.11%, 11.7±4.88% and 5.6±4.17% at 5 min, 2, 4, 8, 16, 24, 32 and 48 hr, respectively from vehicle control (Mean and SEM, n=10-35 mice, from 3 experiments).

3. Duration Response Assessing FIX Polypeptide Procoagulant Activity

Studies were performed to assess the duration of effect of FIX-polypeptides at 0.5 mg/kg in FIX$^{-/-}$ mice. Mice were dosed i.v. at 72 hr, 48 hr, 32 hr, 24 hr, 8 hr and 5 min prior to tail cut, or at 72 hr, 48 hr and 1 hr prior to tail cut. In these experiments, inhibition from the control group was determined where the control group was set at 0% inhibition. Inhibition of blood loss is shown as % inhibition (Mean and SEM) in Table 30.

TABLE 30

Inhibition of blood loss

| Mutation (chymotrypsin numbering) | n/ group | N (expt) | Inhibition (% of vehicle (0) +/− SEM) at each time point (hrs) | | | |
|---|---|---|---|---|---|---|
| | | | 0.08 | 1 | 8 | 24 |
| R150Y/R170E/R233E | 24-30 | 2 | 85 +/− 3.2 | | 88.8 +/− 2.8 | 59.5 +/− 7.3 |
| R150Y/R170E/E240N | 37-44 | 3 | 71.6 +/− 3.9 | | 85.0 +/− 3.8 | 59.4 +/− 6.8 |
| Y[155]F/R150Y/R170E/E240N | 26-29 | 2 | | 74.2 +/− 6.5 | | |
| R150Y/R233E/E240N | 23-29 | 2 | 71.0 +/− 3.7 | | 71.4 +/− 6.6 | 31.1 +/− 6.1 |
| R150Y/R170E/R233E/E240N | 75-86 | 7 | 75.9 +/− 2 | | 82.7 +/− 2.6 | 58 +/− 4.8 |
| Y[155]F/R150Y/R170E/R233E/ E240N | 25-30 | 2 | | 88.5 +/− 1.7 | | |
| D[104]N/K[106]S/Y[155]F/ R150Y/R170E/R233E/E240N | 35-44 | 3 | 70.8 +/− 3.0 | | 85.5 +/− 3.5 | 55.1 +/− 5.4 |
| T175R | 23-28 | 2 | 43.7 +/− 6.3 | | 30.9 +/− 6.6 | 23.8 +/− 3.8 |
| Y[155]F/K63N/R150Y/R170E/ R233E/E240N | 36-43 | 3 | 65.2 +/− 3.0 | | 72.2 +/− 4.5 | 59.2 +/− 6.5 |
| K82N/N84S/R150Y/R170E/ R233E/E240N | 37-41 | 3 | 78.7 +/− 2.5 | | 85.9 +/− 2.6 | 52.5 +/− 5.5 |
| Y[155]F/K82N/N84S/R150Y/ R170E/R233E/E240N | 57-65 | 5 | 79.1 +/− 2.2 | | 79.5 +/− 2.7 | 66.7 +/− 4.0 |
| D[104]N/K[106]S/Y[155]F/K82N/ N84S/R150Y/R170E/R233E/ E240N | 20-29 | 2 | 71.2 +/− 4.5 | | 74.2 +/− 6.6 | 61.2 +/− 7.2 |
| K82N/N84S/R150Y/R170E/ E240N | 23-28 | 2 | | 76.0 +/− 6.6 | | |
| Y[155]F/K82N/N84S/R150Y/ R170E/E240N | 26-30 | 2 | | 77.7 +/− 5.1 | | |

TABLE 30-continued

Inhibition of blood loss

| | | | | | |
|---|---|---|---|---|---|
| R150Y/R170E/R233E/E240S | 35-42 | 3 | 79.3 +/− 1.9 | | 75.6 +/− 4.6 | 51.0 +/− 5.4 |
| K63N/K82N/N84S/R150Y/<br>R170E/R233E/E240N | 32-38 | 3 | 72.6 +/− 2.9 | | 78.6 +/− 3.7 | 44.2 +/− 7 |
| D[104]N/K[106]S/K63N/K82N/<br>N84S/R150Y/R170E/R233E/<br>E240N | 26-28 | 2 | 81.6 +/− 3.5 | | 86.0 +/− 3.6 | 46.8 +/− 8.0 |
| Y[155]F/K63N/K82N/N84S/<br>R150Y/R170E/R233E/E240N | 23-29 | 2 | 85.5 +/− 2.2 | | 75.6 +/− 4.0 | 70.6 +/− 6.5 |
| R150Y/R170E/R233E/E240N/<br>T242V | 40-44 | 3 | 69.5 +/− 3.2 | | 85.5 +/− 2.6 | 37.5 +/− 5.1 |
| R150Y/R170E/R233E/E240N/<br>T242A | 29-38 | 3 | 81.3 +/− 2.5 | | 85.6 +/− 3.3 | 45.2 +/− 6.2 |
| K82N/N84S/N95S/R150Y/R170E/<br>R233E/E240N | 20-28 | 2 | 46.4 +/− 6.6 | | 37.7 +/− 7.5 | 4.0 +/− 2.6 |
| Y[155]F/K82N/N84S/N95S/<br>R150Y/R170E/R233E/E240N | 37-43 | 3 | 72.2 +/− 4.4 | | 69.1 +/− 5.4 | 47.0 +/− 6.1 |
| R150Y/R170E/T175R/R233E/<br>E240N | 32-38 | 3 | 80.3 +/− 2.6 | | 78.2 +/− 3.8 | 68.3 +/− 5.5 |
| Y[155]F/R150Y/R170E/T175R/<br>R233E/E240N | 21-27 | 2 | 84.8 +/− 2.5 | | 87.8 +/− 2.8 | 76.6 +/− 4.2 |
| D[104]N/K[106]S/R150Y/R170E/<br>T175R/R233E/E240N | 26-30 | 2 | 80.4 +/− 2.8 | | 81.5 +/− 4.8 | 69.5 +/− 7.6 |
| R150Y/R170E/T175R/N178Y/<br>R233E/E240N | 35-43 | 3 | 76.6 +/− 3.1 | | 85.1 +/− 3.3 | 43.9 +/− 5.7 |
| Y[155]F/K82N/N84S/R150Y/<br>R170E/R233E | 24-30 | 2 | 76.2 +/− 3.0 | | 85.6 +/− 4.7 | 49.6 +/− 6.5 |
| K82N/N84S/R150Y/R170E/<br>R233E | 27-29 | 2 | | 70.0 +/− 5.8 | | |
| Y[155]F/K82N/N84S/R170E/<br>R233E/E240N | 38-44 | 3 | 69.8 +/− 4.7 | | 78.4 +/− 4.1 | 56.4 +/− 5.9 |
| K82N/N84S/R170E/R233E/<br>E240N | 28-30 | 2 | | 63.9 +/− 7.2 | | |
| R150Y/R170E/T175R/R233E | 37-43 | 3 | 80.0 +/− 2.1 | | 83.5 +/− 3.5 | 62.1 +/− 5.6 |
| Y[155]F/R150Y/R170E/T175R/<br>R233E | 24-28 | 2 | 80.4 +/− 3.0 | | 90.7 +/− 2.1 | 65.7 +/− 6.6 |
| R150Y/R170E/T175R/E240N | 35-44 | 3 | 65.5 +/− 4.7 | | 74.1 +/− 5.3 | 55.8 +/− 5.6 |
| R150Y/T175R/R233E/E240N | 29-30 | 2 | 74.1 +/− 3.6 | | 77.7 +/− 3.9 | 55.3 +/− 7.5 |
| Y[155]F/R150Y/T175R/R233E/<br>E240N | 25-29 | 2 | | 92.7 +/− 2.1 | | |
| R170E/T175R/R233E/E240N | 26-30 | 2 | 67 +/− 5.3 | | 87.4 +/− 4.2 | 55.9 +/− 8.7 |
| Y[155]F/R170E/T175R/R233E/<br>E240N | 34-43 | 3 | 77.8 +/− 4.2 | | 90.8 +/− 2.8 | 68.6 +/− 5.2 |
| Y[155]F/K82N/N84S/R150Y/<br>R170E/T175R/R233E/E240N | 39-43 | 3 | 76.0 +/− 3.0 | | 80.4 +/− 3.3 | 72.7 +/− 3.8 |
| K82N/N84S/R150Y/R170E/<br>T175R/R233E/E240N | 42-44 | 3 | 83.0 +/− 2.4 | | 81.0 +/− 2.4 | 73.8 +/− 5.2 |
| K63N/I86S/R150Y/R170E/R233E/<br>E240N | 21-26 | 2 | 71.9 +/− 3.6 | | 85.8 +/− 4.0 | 71.3 +/− 6.8 |
| Y[155]F/K63N/I86S/R150Y/<br>R170E/R233E/E240N | 26-29 | 2 | 82.1 +/− 2.7 | | 83.6 +/− 3.7 | 65.6 +/− 5.5 |
| N95S/R150Y/R170E/T175R/<br>R233E/E240N | 24-29 | 2 | 75.5 +/− 4.5 | | 76.6 +/− 4.3 | 82.2 +/− 5.8 |
| Y[155]F/N95S/R150Y/R170E/<br>T175R/R233E/E240N | 21-27 | 2 | 85.2 +/− 2.5 | | 89.7 +/− 3.6 | 46.5 +/− 7.0 |
| K63N/K82N/N84S/R150Y/<br>R170E/T175R/R233E/E240N | 34-45 | 3 | 83.9 +/− 1.8 | | 79.8 +/− 3.6 | 75.2 +/− 4.9 |
| Y[155]F/K63N/K82N/N84S/<br>R150Y/R170E/T175R/R233E/<br>E240N | 24-26 | 2 | | 84.6 +/− 3.4 | | |
| Y[155]F/R170E/T175R/R233E | 22-30 | 2 | 81.9 +/− 3.6 | | 79.2 +/− 6.2 | 55.0 +/− 8.0 |
| R170E/T175R/R233E | 23-28 | 2 | 60.6 +/− 6.4 | | 86.5 +/− 4.3 | 35.6 +/− 8.3 |
| Y[155]F/R170E/T175R/R233E/<br>E240S | 24-27 | 2 | 71.2 +/− 4.5 | | 77.8 +/− 5.3 | 54.6 +/− 8.2 |
| Y[155]F/N95S/R170E/T175R/<br>R233E | 25-29 | 2 | 58.2 +/− 7.9 | | 65.5 +/− 8.3 | 48.2 +/− 10.0 |
| Y[155]F/I86S/R170E/T175R/<br>R233E | 23-30 | 2 | 84.1 +/− 5.1 | | 90.9 +/− 2.7 | 76.6 +/− 6.4 |
| R150Y/R170E/T175R/R233E/<br>E240S | 27-43 | 3 | 80.2 +/− 2.5 | | 87.1 +/− 3.2 | 76.9 +/− 4.0 |
| Y[155]F/K82N/N84S/T175R/<br>R233E | 12-29 | 2 | 70.5 +/− 6.9 | 84.2 +/− 5.4 | 53.2 +/− 12.3 | 39.5 +/− 11.1 |
| Y[155]F/K82N/N84S/R150Y/<br>R170E/T175R/R233E | 36-41 | 3 | 79.6 +/− 3.2 | | 90.5 +/− 2.4 | 73.8 +/− 4.6 |
| K82N/N84S/R150Y/R170E/<br>T175R/R233E | 22-28 | 2 | 84.3 +/− 3.1 | | 91.8 +/− 1.4 | 60.1 +/− 6.7 |

TABLE 30-continued

Inhibition of blood loss

| Mutation | Range | N | | | | |
|---|---|---|---|---|---|---|
| Y[155]F/K82N/N84S/R170E/T175R/R233E/E240N | 25-30 | 2 | | 91.1 +/− 1.8 | | |
| K82N/N84S/R170E/T175R/R233E/E240N | 25-28 | 2 | | 82.7 +/− 4.5 | | |
| Y[155]F/K82N/N84S/R150Y/R170E | 20-29 | 2 | | 83.3 +/− 3.9 | | |
| Y[155]F/K82N/N84S/R150Y/T175R | 24-28 | 2 | | 43.6 +/− 6.5 | | |
| Y[155]F/K82N/N84S/R170E/R233E | 15-30 | 2 | 47.2 +/− 8.0 | 64.7 +/− 9.7 | 90.8 +/− 4.5 | 78.4 +/− 7.5 |
| Y[155]F/K82N/N84S/R170E/T175R | 25-27 | 2 | | 70.5 +/− 7.0 | | |
| Y[155]F/K82N/N84S/R150Y/R170E/T175R/E240N | 28-30 | 2 | | 73.7 +/− 6.7 | | |
| K82N/N84S/R150Y/R170E/T175R/E240N | 25-29 | 2 | | 77.2 +/− 6.0 | | |
| Y[155]F/K82N/N84S/R150Y/T175R/R233E/E240N | 26-28 | 2 | | 87.6 +/− 2.4 | | |
| K82N/N84S/R150Y/T175R/R233E/E240N | 28-30 | 2 | | 91.3 +/− 2.6 | | |
| Y[155]F/K82N/N84S/R170E/E240N | 25-30 | 2 | | 74.6 +/− 6.4 | | |
| Y[155]F/K82N/N84S/R150Y/T175R/R233E | 27-30 | 2 | | 85.2 +/− 4.4 | | |
| K82N/N84S/R150Y/T175R/E240N | 25-30 | 2 | | 51.9 +/− 8.2 | | |
| Y[155]F/K82N/N84S/R170E/T175R/R233E | 27-29 | 2 | | 84.6 +/− 5.0 | | |
| K82N/N84S/R170E/T175R/R233E | 27-29 | 2 | | 73.0 +/− 6.6 | | |
| K82N/N84S/R170E/T175R/E240N | 24-29 | 2 | | 59.1 +/− 8.0 | | |
| Y[155]F/K82N/N84S/T175R/R233E/E240N | 28-30 | 2 | | 86.5 +/− 3.9 | | |
| K82N/N84S/T175R/R233E/E240N | 25-29 | 2 | | 59.2 +/− 8.2 | | |
| Y[155]F/T175R/R233E/E240N | 24-28 | 2 | | 78.7 +/− 4.9 | | |
| Y[155]F/K82N/N84S/R150Y/R170E/T175R | 28-30 | 2 | | 82.3 +/− 5.4 | | |
| K82N/N84S/R150Y/R170E/T175R | 37-43 | 3 | | 79.3 +/− 4.2 | | |
| R170E/T175R/E240N | 37-41 | 3 | | 66.6 +/− 5.9 | | |
| R150Y/T175R/E240N | 24-28 | 2 | | 83.5 +/− 5.1 | | |
| K63N/R150Y/R170E/T175R/R233E/E240N | 23-29 | 2 | | 84.5 +/− 3.1 | | |
| K63N/K82N/N84S/R150Y/R170E/T175R/R233E | 22-28 | 2 | | 81.9 +/− 4.1 | | |

| Mutation (chymotrypsin numbering) | Inhibition (% of vehicle (0) +/− SEM) at each time point (hrs) | | |
|---|---|---|---|
| | 32 | 48 | 72 |
| R150Y/R170E/R233E | 71.8 +/− 7.0 | 40.2 +/− 7.8 | 7.8 +/− 5.2 |
| R150Y/R170E/E240N | 55.7 +/− 6.1 | 21.0 +/− 6.2 | 27.7 +/− 7.3 |
| Y[155]F/R150Y/R170E/E240N | | 56.8 +/− 9.0 | 15.6 +/− 8.2 |
| R150Y/R233E/E240N | 15.8 +/− 4.3 | 4.8 +/− 5.4 | −0.4 +/− 2.9 |
| R150Y/R170E/R233E/E240N | 63.6 +/− 4.4 | 31.1 +/− 4.9 | 3.5 +/− 2.7 |
| Y[155]F/R150Y/R170E/R233E/E240N | | 22.2 +/− 8.2 | −17.6 +/− 3.6 |
| D[104]N/K[106]S/Y[155]F/R150Y/R170E/R233E/E240N | 48.3 +/− 7.2 | 27.3 +/− 5.7 | 12.1 +/− 3.0 |
| T175R | 12.3 +/− 6.1 | 14.8 +/− 7.1 | 3.4 +/− 3.1 |
| Y[155]F/K63N/R150Y/R170E/R233E/E240N | 42.4 +/− 8.3 | 41.2 +/− 7.6 | 4.7 +/− 5.6 |
| K82N/N84S/R150Y/R170E/R233E/E240N | 49.9 +/− 6.8 | 31.4 +/− 5.9 | 5.0 +/− 4.2 |
| Y[155]F/K82N/N84S/R150Y/R170E/R233E/E240N | 61.1 +/− 4.8 | 38.2 +/− 5.2 | 17.1 +/− 4.0 |
| D[104]N/K[106]S/Y[155]F/K82N/N84S/R150Y/R170E/R233E/E240N | 48.7 +/− 8.2 | 54.1 +/− 7.7 | 12.3 +/− 6.5 |
| K82N/N84S/R150Y/R170E/E240N | | 26.2 +/− 8.7 | 22.3 +/− 7.1 |
| Y[155]F/K82N/N84S/R150Y/R170E/E240N | | 16.0 +/− 7.3 | −2.2 +/− 4.3 |

TABLE 30-continued

| Inhibition of blood loss | | | |
|---|---|---|---|
| R150Y/R170E/R233E/E240S | 48.3 +/− 6.5 | 12.3 +/− 5.3 | −5.6 +/− 2.4 |
| K63N/K82N/N84S/R150Y/R170E/R233E/E240N | 53.9 +/− 7.1 | 42.9 +/− 6.9 | 10.4 +/− 5.4 |
| D[104]N/K[106]S/K63N/K82N/N84S/R150Y/R170E/R233E/E240N | 59.7 +/− 7.7 | 33.8 +/− 8.3 | 26.2 +/− 5.8 |
| Y[155]F/K63N/K82N/N84S/R150Y/R170E/R233E/E240N | 58.4 +/− 6.3 | 27.0 +/− 7.7 | 14.1 +/− 7.8 |
| R150Y/R170E/R233E/E240N/T242V | 42.8 +/− 6.2 | 9.0 +/− 6.6 | −3.8 +/− 3.4 |
| R150Y/R170E/R233E/E240N/T242A | 35.6 +/− 6.3 | 29.3 +/− 6.0 | 3.7 +/− 3.1 |
| K82N/N84S/N95S/R150Y/R170E/R233E/E240N | 16.0 +/− 4.7 | 0.08 +/− 3.8 | −6.1 +/− 2.4 |
| Y[155]F/K82N/N84S/N95S/R150Y/R170E/R233E/E240N | 44.3 +/− 6.2 | 27.0 +/− 6.4 | 8.1 +/− 5.3 |
| R150Y/R170E/T175R/R233E/E240N | 69.4 +/− 6.0 | 23.2 +/− 7.2 | 4.9 +/− 5.8 |
| Y[155]F/R150Y/R170E/T175R/R233E/E240N | 66.7 +/− 6.6 | 56.8 +/− 8.0 | 8.2 +/− 8.0 |
| D[104]N/K[106]S/R150Y/R170E/T175R/R233E/E240N | 60.4 +/− 7.9 | 54.8 +/− 6.7 | 12.8 +/− 6.3 |
| R150Y/R170E/T175R/N178Y/R233E/E240N | 47.9 +/− 6.8 | 14.9 +/− 6.2 | −12.1 +/− 2.9 |
| Y[155]F/K82N/N84S/R150Y/R170E/R233E | 61.1 +/− 7.4 | 46.0 +/− 6.9 | 0.4 +/− 4.9 |
| K82N/N84S/R150Y/R170E/R233E | | 18.8 +/− 6.3 | 2.1 +/− 2.7 |
| Y[155]F/K82N/N84S/R170E/R233E/E240N | 58.4 +/− 5.8 | 51.1 +/− 6.6 | 26.9 +/− 5.4 |
| K82N/N84S/R170E/R233E/E240N | | 16.7 +/− 6.3 | −7.0 +/− 2.0 |
| R150Y/R170E/T175R/R233E | 62.6 +/− 5.3 | 50.5 +/− 5.9 | 1.9 +/− 4.0 |
| Y[155]F/R150Y/R170E/T175R/R233E | 67.2 +/− 7.3 | 52.2 +/− 8.2 | 41.1 +/− 8.3 |
| R150Y/R170E/T175R/E240N | 53.1 +/− 6.8 | 46.4 +/− 6.7 | 34.9 +/− 6.0 |
| R150Y/T175R/R233E/E240N | 39.4 +/− 8.1 | 24.5 +/− 7.6 | 6.8 +/− 4.8 |
| Y[155]F/R150Y/T175R/R233E/E240N | | 29.3 +/− 6.1 | 7.7 +/− 3.2 |
| R170E/T175R/R233E/E240N | 47.2 +/− 8.6 | 33.0 +/− 8.4 | 9.2 +/− 5.3 |
| Y[155]F/R170E/T175R/R233E/E240N | 61.3 +/− 5.8 | 35.6 +/− 8.3 | 5.9 +/− 5.0 |
| Y[155]F/K82N/N84S/R150Y/R170E/T175R/R233E/E240N | 64.2 +/− 5.4 | 51.4 +/− 5.7 | 33.1 +/− 7.3 |
| K82N/N84S/R150Y/R170E/T175R/R233E/E240N | 57.1 +/− 5.7 | 48.5 +/− 6.1 | 16.9 +/− 6.8 |
| K63N/I86S/R150Y/R170E/R233E/E240N | 54.8 +/− 7.3 | 40.3 +/− 10.3 | 23.1 +/− 10.4 |
| Y[155]F/K63N/I86S/R150Y/R170E/R233E/E240N | 57.2 +/− 7.9 | 38.4 +/− 8.9 | 16.5 +/− 7.7 |
| N95S/R150Y/R170E/T175R/R233E/E240N | 84.7 +/− 3.9 | 41.6 +/− 8.6 | 20.1 +/− 6.0 |
| Y[155]F/N95S/R150Y/R170E/T175R/R233E/E240N | 63.3 +/− 8.0 | 41.6 +/− 8.8 | 9.1 +/− 6.5 |
| K63N/K82N/N84S/R150Y/R170E/T175R/R233E/E240N | 80.9 +/− 3.0 | 73.0 +/− 4.4 | 43.8 +/− 6.6 |
| Y[155]F/K63N/K82N/N84S/R150Y/R170E/T175R/R233E/E240N | | 70.6 +/− 7.5 | 50.9 +/− 8.6 |
| Y[155]F/R170E/T175R/R233E | 44.4 +/− 9.9 | 26.8 +/− 6.8 | −6.5 +/− 2.7 |
| R170E/T175R/R233E | 35.8 +/− 8.5 | 18.9 +/− 6.8 | 12.1 +/− 6.0 |
| Y[155]F/R170E/T175R/R233E/E240S | 58.3 +/− 8.1 | 21.9 +/− 7.1 | −11.0 +/− 3.4 |
| Y[155]F/N95S/R170E/T175R/R233E | 29.3 +/− 9.3 | 21.0 +/− 6.7 | −14.8 +/− 5.3 |
| Y[155]F/I86S/R170E/T175R/R233E | 62.4 +/− 6.7 | 55.2 +/− 7.9 | 23.7 +/− 6.5 |
| R150Y/R170E/T175R/R233E/E240S | 67.9 +/− 5.6 | 48.3 +/− 5.5 | 21.0 +/− 5.0 |
| Y[155]F/K82N/N84S/T175R/R233E | 18.0 +/− 7.3 | 17.0 +/− 5.4 | −7.4 +/− 3.1 |
| Y[155]F/K82N/N84S/R150Y/R170E/T175R/R233E | 75.0 +/− 5.0 | 74.4 +/− 4.7 | 27.5 +/− 6.5 |
| K82N/N84S/R150Y/R170E/T175R/R233E | 54.0 +/− 8.1 | 43.6 +/− 8.8 | 35.7 +/− 8.7 |
| Y[155]F/K82N/N84S/R170E/T175R/R233E/E240N | | 22.7 +/− 6.6 | 12.8 +/− 6.2 |

TABLE 30-continued

Inhibition of blood loss

| Variant | | |
|---|---|---|
| K82N/N84S/R170E/T175R/R233E/E240N | | 67.1 +/− 7.7 | 21.6 +/− 8.0 |
| Y[155]F/K82N/N84S/R150Y/R170E | | 47.8 +/− 7.0 | 19.4 +/− 6.2 |
| Y[155]F/K82N/N84S/R150Y/T175R | | 4.9 +/− 4.6 | 7.2 +/− 1.9 |
| Y[155]F/K82N/N84S/R170E/R233E | 49.2 +/− 11.5 | 19.7 +/− 7.9 | −5.8 +/− 4.2 |
| Y[155]F/K82N/N84S/R170E/T175R | | 34.0 +/− 7.4 | 27.9 +/− 6.4 |
| Y[155]F/K82N/N84S/R150Y/R170E/T175R/E240N | | 30.1 +/− 8.4 | 43.1 +/− 7.9 |
| K82N/N84S/R150Y/R170E/T175R/E240N | | 29.5 +/− 7.2 | 29.0 +/− 5.5 |
| Y[155]F/K82N/N84S/R150Y/T175R/R233E/E240N | | 42.6 +/− 8.6 | 14.5 +/− 6.4 |
| K82N/N84S/R150Y/T175R/R233E/E240N | | 52.4 +/− 7.7 | 6.6 +/− 4.5 |
| Y[155]F/K82N/N84S/R170E/E240N | | 30.1 +/− 7.1 | 12.4 +/− 6.3 |
| Y[155]F/K82N/N84S/R150Y/T175R/R233E | | 31.1 +/− 7.8 | −7.9 +/− 2.6 |
| K82N/N84S/R150Y/T175R/E240N | | 9.4 +/− 4.9 | 3.2 +/− 4.5 |
| Y[155]F/K82N/N84S/R170E/T175R/R233E | | 26.8 +/− 8.5 | 10.9 +/− 6.9 |
| K82N/N84S/R170E/T175R/R233E | | 27.3 +/− 7.7 | 23.4 +/− 5.6 |
| K82N/N84S/R170E/T175R/E240N | | 29.6 +/− 7.4 | 12.2 +/− 5.2 |
| Y[155]F/K82N/N84S/T175R/R233E/E240N | | 34.6 +/− 8.1 | −2.3 +/− 4.0 |
| K82N/N84S/T175R/R233E/E240N | | 1.0 +/− 4.0 | −7.3 +/− 2.8 |
| Y[155]F/T175R/R233E/E240N | | −5.7 +/− 2.8 | −4.2 +/− 3.7 |
| Y[155]F/K82N/N84S/R150Y/R170E/T175R | | 64.6 +/− 7.4 | 41.4 +/− 7.7 |
| K82N/N84S/R150Y/R170E/T175R | | 47.7 +/− 5.3 | 20.9 +/− 5.5 |
| R170E/T175R/E240N | | 31.5 +/− 6 | 10.4 +/− 3.6 |
| R150Y/T175R/E240N | | 36.7 +/− 8.9 | 20.0 +/− 6.7 |
| K63N/R150Y/R170E/T175R/R233E/E240N | | 66.3 +/− 7.8 | 41.2 +/− 8.5 |
| K63N/K82N/N84S/R150Y/R170E/T175R/R233E | | 62.2 +/− 8.2 | 28.6 +/− 8.0 |

Example 8

Determination of the Functional Cofactor Binding ($K_{D-app}$) of FIXa for its Cofactor, Factor VIIIa The functional cofactor binding ($K_{D-app}$) of the FIXa variants for the cofactor Factor VIIIa (FVIIIa) in the presence or saturating substrate, Factor X (FX), was assessed indirectly in a fluorogenic assay by assaying for the activity of FXa, generated upon activation by FIXa, on the synthetic substrate Spectrafluor FXa. A range of FVIIIa concentrations were used to calculate the apparent kinetic rate constant ($K_{D-app}$) where the cofactor (FVIIIa) was in excess by at least a 1000-fold over the concentration of the activating protease (FIXa). The experiment was designed to be a variation of the assay described in Example 4 (Determination of the Catalytic Activity of FIXa for its Substrate, Factor X) where the cofactor (FVIIIa) at various concentrations is preincubated with FIXa in the presence of phospholipid vesicles forming the tenase (Xase) complex prior to assessing the catalytic activity with saturating levels of the substrate, FX. Briefly, activated and active site titrated FIXa was incubated in a calcium-containing buffer with phospholipid vesicles while separately recombinant FVIII is activated (to FVIIIa) with alpha-thrombin. The activity of alpha-thrombin was then quenched by the addition of a highly specific thrombin inhibitor, hirudin, prior to initiating the assay. FIXa variants were then mixed with various concentrations of FVIIIa to form the Xase complex and subsequently mixed with saturating concentrations of FX and the fluorescent substrate, Spectrafluor FXa ($CH_3SO_2$-D-CHA-Gly-Arg-AMC) to initiate the assay. The release of the free fluorophore, AMC (7-amino-4-methylcoumarin) following catalysis of Spectrafluor FXa by FXa was then assessed continuously over a time period, and the kinetic rate constants of the FIXa variants determined.

A. Assay Protocol

For assays evaluating the kinetic rate of FX activation by FIXa in the presence of various FVIIIa concentrations and phospholipids, recombinant FVIII (Kogenate FS®; Bayer healthcare) was first resuspended in 1 mL of the provided diluent. The molar concentration of FVIII was then determined by absorbance at 280 nm using an extinction coefficient of $1.567\ mg^{-1}\ mL\ cm^{-1}$ and a molecular weight of 163.6 kDa. The FIX variants were expressed, purified, activated and active site titrated as described in Examples 1-3, above. FIXa variants were then serially diluted to a concentration of 8 pM (4×) in a 1 mL volume of 1× Buffer A (20 mM Hepes/150 mM NaCl/5 mM $CaCl_2$/0.1% BSA/0.1% PEG-8000, pH 7.4). In preparation for activation of FVIII to FVIIIa in the presence phospholipids, alpha-thrombin (Heamatologic Technologies, Inc.) and hirudin (American Diagnostica) were each diluted from the manufacturer's stock concentrations 1:100 in 1× Buffer A. Reconstituted FVIII was further diluted to a concentration of 1600 nM (4× of the top dose) in a 1.6 mL volume of 1× Buffer A containing 400 µM freshly resuspended phospholipids (75% phosphatidylcholine (PC)/25% phosphatidylserine (PS); PS/PC vesicles ~120 nm in diameter; Avanti Polar Lipids). FVIII was activated to FVIIIa by mixing the above FVIII/PC/PS solution with a final concentration of 15 nM alpha-thrombin solutions followed by 15 minutes of incubation at 25° C. Activation reactions were subsequently quenched by the addition of hirudin to a final concentration of 150 nM for 5 min at 25° C. prior to initiating a dilution series of 1.5-fold in a 12-channel deep-well polypropylene plate with a final volume of 0.5 mL of the activated FVIIIa into 1× Buffer A containing 400 µM PC/PS vesicles. The final concentrations of FVIIIa (4×) were 1600 nM, 1066.7 nM, 711.1 nM, 474.1 nM, 316.1 nM, 210.7 nM, 140.5 nM, 93.6 nM, 62.43 nM, 41.6 nM. 27.8 nM and 0 nM for a 12-point assay or for an alternative 8-point assay with a 2-fold dilution series; 1600 nM, 600 nM, 400 nM, 200 nM, 100 nM, 50 nM, 25 nM and 0 nM. The dilution series of FVIIIa was subsequently mixed 1:1 with the 4× FIXa dilutions (12.5 µL each) in a 96-well half-area black assay plate according to a predefined plate map (4 FIXa variants/plate) and preincubated 15 min at 25° C. to form Xase complexes with varied concentrations of FVIIIa. Final 2× solutions (25 µL) were as follows: 4 µM FIXa variant, 1600-0 nM FVIIIa, 200 µM PC/PS vesicles, 7.5 nM alpha-thrombin (inhibited) and 75 nM hirudin.

A solution of 1000 nM (2×) active site titrated and DFP/EGR-cmk treated FX (see Example 2, above) was prepared in 20 mL of 1× Buffer A containing 1.0 mM Spectrafluor Xa substrate providing a sufficient volume for 4 assays. This represented a 2× saturating concentration of FX that would be at least 5-20-fold above the $K_M$ values reported in Example 4, Table 16. Assay reactions were typically initiated using a BioMek FX liquid handling system programmed to dispense 25 µL of the FX/Spectrafluor Xa dilutions into 4 assay plates containing 25 µL of each FIXa variant and FVIIIa dilution (Xase complexes). The final concentrations of the reagents in the assay were as follows: 2 pM FIXa, 400-0 nM 100 µM PC/PS vesicles, 0.5 mM Spectrafluor Xa, 3.8 nM alpha-thiombin (inhibited), 38 nM hirudin and FX at 500 nM. Reactions were monitored in a SpectraMax fluorescence plate reader for 30 mM at 37° C. A standard curve of free AMC served as the conversion factor for RFU to µM in the subsequent data analysis calculations using a dose range that covered 0 µM to 100 µM AMC.

B. Data Analysis

To determine functional affinity of FIXa variants for FVIIIa based on their catalytic activity, raw data collected with the SoftMax Pro application (Molecular Devices) were exported as .TXT files. Further non-linear data analyses were performed directly within the ActivityBase software package using the XE Runner data analysis module (IDBS Software). Data analyses were essentially as described in Example 4B with minor modifications. The Abase template was set up to automatically fit the parabolic reaction velocities (µM/sec$^2$) of the tested FIXa variants at each FVIIIa concentration to the function of a standard rectangular hyperbola (i.e. Michaelis Menten equation) given by equation (1) to yield the fit values for $V_{max}$ and $K_{D-app}$.

$$\text{Reaction Velocity}(\mu M/\sec^2) = \frac{V_{max}[S_0]}{K_{D-app} + [S_0]} \quad \text{Equation (1)}$$

Table 31 sets forth the functional affinity ($K_{D-app}$) for each of the FIXa variants assayed. Also assayed were recombinant wild-type FIXa (termed Catalyst Biosciences WT; generated as described above in Example 1), plasma purified FIXa (Haematologic Technologies, Inc.), and BeneFIX® (Coagulation Factor IX (Recombinant); Wyeth). Table XX presents the results expressed as the kinetic constant for affinity, $K_{D-app}$ (nM), and also as ratio of the functional affinity of the wild-type FIXa compared to that of the FIXa variant, wherein the functional affinity of each FIXa variant is defined by the $K_{D-app}$ (nM) value for activation of the substrate, FX. Where the activity of the FIXa variant was compared to wild-type FIXa, it was compared to a recombinant wild-type FIXa polypeptide that was expressed and purified using the same conditions as used for the variant FIXa polypeptides to ensure that any differences in activity were the result of the mutation(s), and not the result of differences in, for example, post-translational modifications associated with different expression systems. Thus, the wild-type FIXa polypeptide used for comparison was the recombinant wild-type FIXa generated from cloning the FIX gene set forth in SEQ ID NO:1 and expressed from CHOX cells as a polypeptide with an amino acid sequence set forth in SEQ ID NO:3, as described in Example 1 (i.e. Catalyst Biosciences WT FIX polypeptide). The standard deviation (S.D.), coefficient of variation (as a percentage; % CV) and the number of assays performed (n) also are provided.

While some variants showed similar to wild-type affinities or nominal increases in $K_{D-app}$ (e.g. FIXa-R318Y/R338E and FIXa-R318Y/R338E/R403E/E410N) several variants showed marked increases in functional affinity with greater than 6-10 fold increases in $K_{D-app}$. Variants with combinations of the R338E, T343R and E410N mutations showed the greatest improvements in functional affinity. For instance, FIXa-R338E/T343R, FIXa-R318Y/R338E/T343R/E410N, FIXa-R318Y/R338E/E410N, FIXa-Y155F/K247N/N249S/R318Y/R338E/T343R/R403E/E410N, FIXa-R338E/E410N and FIXa-K228N/247N/N249S/R318Y/R338E/T343R/E410N are among this group.

TABLE 31

Functional Cofactor Affinity of FIXa variants ($K_{D-app}$)

| Mutation (Mature FIX Numbering) | Mutation (Chymotrypsin Numbering) | $K_{D-app}$ (nM) | ±S.D. (nM) | % CV | $K_{D-WT}/K_{D-mut}$ | n |
|---|---|---|---|---|---|---|
| BeneFIX Benefix ® Coagulation FIX (T148A) | BeneFIX Benefix ® Coagulation FIX (T[148]A) | 90.2 | 13.5 | 15% | 1.1 | 4 |
| Plasma Purified FIXa | Plasma Purified FIXa | 101.6 | 5.8 | 6% | 0.9 | 3 |
| Catalyst Biosciences WT | Catalyst Biosciences WT | 95.5 | 4.6 | 5% | 1.0 | 2 |
| T148A | T[148]A | 79.7 | 27.1 | 34% | 1.2 | 2 |
| D104N/K106S/I251S | D[104]N/K[106]S/I86S | 305.5 | 119.5 | 39% | 0.3 | 2 |
| A262S | A95bS | 94.1 | 18.3 | 19% | 1.0 | 2 |

TABLE 31-continued

Functional Cofactor Affinity of FIXa variants ($K_{D-app}$)

| Mutation (Mature FIX Numbering) | Mutation (Chymotrypsin Numbering) | $K_{D-app}$ (nM) | ±S.D. (nM) | % CV | $K_{D-WT}/K_{D-mut}$ | n |
|---|---|---|---|---|---|---|
| E410N | E240N | 74.2 | 0.6 | 1% | 1.3 | 2 |
| E239N | E74N | 77.3 | 40.6 | 53% | 1.2 | 2 |
| T241N/H243S | T76N/H78S | 75.5 | 26.2 | 35% | 1.3 | 2 |
| S319N/L321S | S151N/L153S | 52.4 | 0.7 | 1% | 1.8 | 2 |
| R318E | R150E | 67.0 | 5.2 | 8% | 1.4 | 2 |
| R318Y | R150Y | 192.0 | 55.2 | 29% | 0.5 | 2 |
| R312Q | R143Q | 45.2 | 5.6 | 12% | 2.1 | 2 |
| R312A | R143A | 52.9 | 5.9 | 11% | 1.8 | 2 |
| R312Y | R143Y | 85.2 | 36.5 | 43% | 1.1 | 2 |
| R312L | R143L | 68.9 | 15.6 | 23% | 1.4 | 2 |
| V202Y | V38Y | 61.5 | 3.5 | 6% | 1.6 | 2 |
| D203Y | D39Y | 77.4 | 11.8 | 15% | 1.2 | 2 |
| A204M | A40M | 60.6 | 9.0 | 15% | 1.6 | 2 |
| K400A/R403A | K230A/R233A | 129.5 | 13.4 | 10% | 0.7 | 2 |
| K400E/R403E | K230E/R233E | 298.0 | 58.0 | 19% | 0.3 | 2 |
| R403E | R233E | 654.0 | 131.6 | 20% | 0.1 | 3 |
| K400A | K230A | 98.9 | 7.2 | 7% | 1.0 | 2 |
| K293A | K126A | 86.6 | 4.0 | 5% | 1.1 | 2 |
| R338E | R170E | 43.0 | 7.2 | 17% | 2.2 | 2 |
| R338E/R403E | R170E/R233E | 183.0 | 42.4 | 23% | 0.5 | 2 |
| R338E/E410N | R170E/E240N | 4.1 | 1.4 | 33% | 23.5 | 3 |
| R338E/R403E/E410N | R170E/R233E/E240N | 54.9 | 3.0 | 6% | 1.7 | 2 |
| R318Y/R338E/R403E | R150Y/R170E/R233E | 340.0 | 244.7 | 72% | 0.3 | 2 |
| R403E/E410N | R233E/E240N | 910.5 | 197.3 | 22% | 0.1 | 2 |
| R318Y/R338E/E410N | R150Y/R170E/E240N | 7.7 | 4.6 | 60% | 12.4 | 17 |
| D104N/K106S/R318Y/R338E/E410N | D[104]N/K[106]S/R150Y/R170E/E240N | 12.4 | n.d. | n.d. | 7.7 | 1 |
| R318Y/R338E/R403E/E410N | R150Y/R170E/R233E/E240N | 47.0 | 12.4 | 26% | 2.0 | 12 |
| D104N/K106S/Y155F/R318Y/R338E/R403E/E410N | D[104]N/K[106]S/Y[155]F/R150Y/R170E/R233E/E240N | 61.6 | n.d. | n.d. | 1.6 | 1 |
| K316N | K148N | 66.4 | 8.3 | 13% | 1.4 | 2 |
| H257E | H92E | 81.3 | 2.5 | 3% | 1.2 | 2 |
| E410S | E240S | 99.6 | 2.0 | 2% | 1.0 | 2 |
| N346D | N178D | 126.5 | 3.5 | 3% | 0.8 | 2 |
| N346Y | N178Y | 65.7 | n.d. | n.d. | 1.5 | 1 |
| Y345A | Y177A | 29.6 | 2.3 | 8% | 3.2 | 2 |
| T343R | T175R | 58.4 | 16.2 | 28% | 1.6 | 3 |
| T343R/Y345T | T175R/Y177T | 68.1 | n.d. | n.d. | 1.4 | 1 |
| R318Y/R338E | R150Y/R170E | 28.9 | n.d. | n.d. | 3.3 | 1 |
| Y259F/K265T/Y345T | Y94F/K98T/Y177T | 115.2 | n.d. | n.d. | 0.8 | 1 |
| K228N/I251S | K63N/I86S | 89.7 | 1.3 | 1% | 1.1 | 2 |
| Y155F/K228N/R318Y/R338E/R403E/E410N | Y[155]F/K63N/R150Y/R170E/R233E/E240N | 31.2 | 4.8 | 15% | 3.1 | 2 |
| I251S/R318Y/R338E/R403E/E410N | I86S/R150Y/R170E/R233E/E240N | 62.7 | 0.6 | 1% | 1.5 | 2 |
| D104N/K106S/I251S/R318Y/R338E/R403E/E410N | D[104]N/K[106]S/I86S/R150Y/R170E/R233E/E240N | 54.7 | 19.9 | 36% | 1.7 | 5 |
| I251S/R318Y/R338E/E410N | I86S/R150Y/R170E/E240N | 5.7 | 1.1 | 20% | 16.7 | 3 |
| D104N/K106S/I251S/R318Y/R338E/E410N | D[104]N/K[106]S/I86S/R150Y/R170E/E240N | 12.4 | 1.1 | 9% | 7.7 | 2 |
| K247N/N249S/R318Y/R338E/R403E/E410N | K82N/N84S/R150Y/R170E/R233E/E240N | 68.6 | 17.3 | 25% | 1.4 | 3 |
| Y155F/K247N/N249S/R318Y/R338E/R403E/E410N | Y[155]F/K82N/N84S/R150Y/R170E/R233E/E240N | 45.8 | 4.6 | 10% | 2.1 | 7 |
| A103N/N105S/K247N/N249S/R318Y/R338E/R403E/E410N | A[103]N/N[105]S/K82N/N84S/R150Y/R170E/R233E/E240N | 93.1 | 8.4 | 9% | 1.0 | 2 |
| D104N/K106S/K247N/N249S/R318Y/R338E/R403E/E410N | D[104]N/K[106]S/K82N/N84S/R150Y/R170E/R233E/E240N | 87.4 | 10.3 | 12% | 1.1 | 2 |
| Y155F/K247N/N249S/R318Y/R338E/E410N | Y[155]F/K82N/N84S/R150Y/R170E/E240N | 7.4 | n.d. | n.d. | 12.8 | 1 |
| R318Y/R338E/R403E/E410S | R150Y/R170E/R233E/E240S | 53.1 | 10.4 | 20% | 1.8 | 3 |
| R318Y/R338E/E410S | R150Y/R170E/E240S | 6.8 | 0.2 | 3% | 14.1 | 3 |
| K228N/K247N/N249S | K63N/K82N/N84S | 113.0 | 0.0 | 0% | 0.8 | 2 |
| K228N/K247N/N249S/R318Y/R338E/R403E/E410N | K63N/K82N/N84S/R150Y/R170E/R233E/E240N | 100.5 | n.d. | n.d. | 0.9 | 1 |
| R318Y/R338E/R403E/E410N/T412V | R150Y/R170E/R233E/E240N/T242V | 55.0 | n.d. | n.d. | 1.7 | 1 |
| R318Y/R338E/E410N/T412V | R150Y/R170E/E240N/T242V | 8.9 | n.d. | n.d. | 10.7 | 1 |
| R318Y/R338E/N346D/R403E/E410N | R150Y/R170E/N178D/R233E/E240N | 109.7 | 44.3 | 40% | 0.9 | 2 |
| K247N/N249S/N260S | K82N/N84S/N95S | 147.0 | 60.8 | 41% | 0.6 | 2 |
| Y155F/K247N/N249S/N260S | Y[155]F/K82N/N84S/N95S | 167.0 | 97.7 | 58% | 0.6 | 2 |
| D104N/K106S/K247N/N249S/N260S | D[104]N/K[106]S/K82N/N84S/N95S | 330.0 | 319.6 | 97% | 0.3 | 2 |

TABLE 31-continued

Functional Cofactor Affinity of FIXa variants ($K_{D\text{-}app}$)

| Mutation (Mature FIX Numbering) | Mutation (Chymotrypsin Numbering) | $K_{D\text{-}app}$ (nM) | ±S.D. (nM) | % CV | $K_{D\text{-}WT}/K_{D\text{-}mut}$ | n |
|---|---|---|---|---|---|---|
| D104N/K106S/Y155F/K247N/N249S/N260S | D[104]N/K[106]S/Y[155]F/K82N/N84S/N95S | 142.0 | 73.5 | 52% | 0.7 | 2 |
| K247N/N249S/N260S/R318Y/R338E/R403E/E410N | K82N/N84S/N95S/R150Y/R170E/R233E/E240N | 65.0 | 10.8 | 17% | 1.5 | 2 |
| R318Y/R338E/T343R/R403E/E410N | R150Y/R170E/T175R/R233E/E240N | 14.5 | 4.0 | 28% | 6.6 | 7 |
| R338E/T343R | R170E/T175R | 3.4 | 0.6 | 18% | 28.0 | 2 |
| T343R/N346Y | T175R/N178Y | 38.6 | n.d. | n.d. | 2.5 | 1 |
| R318Y/R338E/N346Y/R403E/E410N | R150Y/R170E/N178Y/R233E/E240N | 39.6 | n.d. | n.d. | 2.4 | 1 |
| R318Y/R338E/T343R/N346Y/R403E/E410N | R150Y/R170E/T175R/N178Y/R233E/E240N | 15.6 | 0.1 | 1% | 6.1 | 2 |
| T343R/N346D | T175R/N178D | 78.4 | n.d. | n.d. | 1.2 | 1 |
| R318Y/R338E/T343R/N346D/R403E/E410N | R150Y/R170E/T175R/N178D/R233E/E240N | 76.2 | n.d. | n.d. | 1.3 | 1 |
| R318Y/R338E/T343R/E410N | R150Y/R170E/T175R/E240N | 6.1 | n.d. | n.d. | 15.7 | 1 |
| Y155F/R318Y/R338E/T343R/E410N | Y[155]F/R150Y/R170E/T175R/E240N | 7.4 | n.d. | n.d. | 12.8 | 1 |
| R318Y/T343R/R403E/E410N | R150Y/T175R/R233E/E240N | 84.1 | 17.8 | 21% | 1.1 | 2 |
| R338E/T343R/R403E/E410N | R170E/T175R/R233E/E240N | 29.4 | n.d. | n.d. | 3.2 | 1 |
| Y155F/R338E/T343R/R403E/E410N | Y[155]F/R170E/T175R/R233E/E240N | 28.5 | n.d. | n.d. | 3.3 | 1 |
| Y155F/K247N/N249S/R318Y/R338E/T343R/R403E/E410N | Y[155]F/K82N/N84S/R150Y/R170E/T175R/R233E/E240N | 15.3 | 1.3 | 9% | 6.3 | 3 |
| K228N/K247N/N249S/R318Y/R338E/T343R/R403E/E410N | K63N/K82N/N84S/R150Y/R170E/T175R/R233E/E240N | 29.1 | 0.3 | 1% | 3.3 | 2 |
| Y155F/K228N/K247N/N249S/R318Y/R338E/T343R/R403E/E410N | Y[155]F/K63N/K82N/N84S/R150Y/R170E/T175R/R233E/E240N | 37.0 | 5.7 | 16% | 2.6 | 2 |
| Y155F/R338E/T343R/R403E | Y[155]F/R170E/T175R/R233E | 72.1 | n.d. | n.d. | 1.3 | 1 |
| R338E/T343R/R403E | R170E/T175R/R233E | 55.0 | n.d. | n.d. | 1.7 | 1 |
| R318Y/R338E/T343R/R403E/E410S | R150Y/R170E/T175R/R233E/E240S | 23.2 | n.d. | n.d. | 4.1 | 1 |
| Y155F/K247N/N249S/R338E/T343R | Y[155]F/K82N/N84S/R170E/T175R | 15.4 | n.d. | n.d. | 6.2 | 1 |
| Y155F/K247N/N249S/R318Y/R338E/T343R/E410N | Y[155]F/K82N/N84S/R150Y/R170E/T175R/E240N | 13.9 | n.d. | n.d. | 6.9 | 1 |
| Y155F/K247N/N249S/R338E/E410N | Y[155]F/K82N/N84S/R170E/E240N | 24.9 | n.d. | n.d. | 3.8 | 1 |
| K247N/N249S/R338E/T343R/E410N | K82N/N84S/R170E/T175R/E240N | 14.0 | n.d. | n.d. | 6.8 | 1 |
| Y155F/R318Y/R338E/T343R | Y[155]F/R150Y/R170E/T175R | 8.4 | n.d. | n.d. | 11.3 | 1 |
| R318Y/R338E/T343R | R150Y/R170E/T175R | 9.8 | n.d. | n.d. | 9.7 | 1 |
| Y155F/K247N/N249S/R318Y/R338E/T343R | Y[155]F/K82N/N84S/R150Y/R170E/T175R | 14.0 | n.d. | n.d. | 6.8 | 1 |
| K247N/N249S/R318Y/R338E/T343R | K82N/N84S/R150Y/R170E/T175R | 14.7 | n.d. | n.d. | 6.5 | 1 |
| Y155F/R338E/T343R/E410N | Y[155]F/R170E/T175R/E240N | 8.5 | n.d. | n.d. | 11.2 | 1 |
| R338E/T343R/E410N | R170E/T175R/E240N | 7.5 | n.d. | n.d. | 12.8 | 1 |
| Y155F/R318Y/T343R/E410N | Y[155]F/R150Y/T175R/E240N | 38.0 | n.d. | n.d. | 2.5 | 1 |
| K228N/R150Y/R338E/T343R/R403E/E410N | K63N/R150Y/R170E/T175R/R233E/E240N | 17.5 | n.d. | n.d. | 5.4 | 1 |
| K228N/247N/N249S/R318Y/R338E/T343R/E410N | K63N/K82N/N84S/R150Y/R170E/T175R/E240N | 7.8 | n.d. | n.d. | 12.2 | 1 |

Example 9

Determination of the Clotting Activities of FIX Variants in Hemophilia B Plasma

Clotting activities for FIX variants were determine by an activated partial thromboplastin time (aPTT) assay in human hemophilia B plasma from a single donor with <1% clotting activity (George King Bio-Medical, Inc., Overland Park, Kans.) per the manufacturer's instructions. Briefly, the aPTT assay involves the recalcification of plasma in the presence of a blend of purified phospholipids (platelet substitute) and activators (kaolin and sulphatide). The aPTT assay was performed using the Dapttin®TC aPTT reagent (Technoclone GmbH, Vienna, Austria) essentially as described in the manufacturers' product insert with FIX variants spiked into the hemophilia B plasma at final concentrations of 100 nM, 10 nM or 1 nM FIX variant. Briefly, FIX variants were diluted to 1 µM in 1× Buffer A (20 mM Hepes/150 mM NaCl/0.5% BSA, pH 7.4) based on the active site titrated zymogen concentration (Example 2). FIX variants were subsequently serially diluted to 100 nM, 10 nM and 1 nM directly into citrated human hemophilia B plasma (George King Bio-Medical). A 100 µL volume of each FIX dilution in plasma was mixed with 100 µL of the Dapttin®TC aPTT reagent and incubated at 37° C. for 180 seconds. Coagulation was initiated by the addition of 100 µL of 25 mM calcium (Diagnostica Stago, Asnieres, France). Coagulation time in seconds was measured using a STArt4 instrument (Diagnostica Stago, Asnieres, France). Each experiment represents the average of two independent clotting time measurements, which typically showed <5% CV.

Table 32 sets forth the clotting activities for each of the FIX variants assayed. Also assayed were recombinant wild-type FIX (termed Catalyst Biosciences WT; generated as described above in Example 1), and BeneFIX® (Coagulation Factor IX (Recombinant); Wyeth). Table XX presents the results expressed as the time to clot at each of the three tested FIX concentrations; 100 nM, 10 nM and 1 nM, wherein each FIX concentration represents ~100%, ~10% and ~1% of the normal concentration of FIX in pooled normal plasma (PNP). Under identical assay conditions, 100% PNP shows a clotting time of 31.3±2.0 seconds, whereas clotting times for 10% and 1% dilutions of PNP in hemophilia B plasma are 42.7±1.7 and 55.0±4.7 seconds, respectively (n=4). The time to clot for the hemophilia B plasma used in these analyses was evaluated 83.2±9.2 seconds (n=5). A number of tested variants demonstrated clotting times similar to or slightly prolonged compared to the wild-type FIXa, where wild-type FIXa polypeptide used for comparison was the recombinant wild-type FIXa expressed from CHOX cells as a polypeptide with an amino acid sequence set forth in SEQ ID NO:3, as described in Example 1 (i.e. Catalyst Biosciences WT FIX polypeptide). On the other hand, several variants showed significantly shortened clotting times. Among this group of variants are FIXa-R318Y/R338E/T343R, FIXa-R318Y/R338E/E410N, FIXa-R338E/T343R/E410N, FIXa-R318Y/R338E/T343R/E410N, FIXa-K247N/N249S/R338E/T343R/E410N and FIXa-K228N/247N/N249S/R318Y/R338E/T343R/E410N.

TABLE 32

Clotting Activity (aPTT) of FIX Variants in Hemophilia B Plasma

| Mutation (Mature FIX Numbering) | Mutation (Chymotrypsin Numbering) | aPTT (100 nM) (s) | ±S.D. | aPTT (10 nM) (s) | ±S.D. | aPTT (1.0 nM) (s) | ±S.D. | n |
|---|---|---|---|---|---|---|---|---|
| BeneFIX Benefix® Coagulation FIX (T148A) | BeneFIX Benefix® Coagulation FIX (T[148]A) | 35.2 | n.d. | 47.4 | n.d. | 63.5 | n.d. | 1 |
| Catalyst Biosciences WT | Catalyst Biosciences WT | 35.5 | n.d. | 46.9 | n.d. | 60.6 | n.d. | 1 |
| T148A | T[148]A | 33.2 | n.d. | 43.1 | n.d. | 59.2 | n.d. | 1 |
| R338E/R403E | R170E/R233E | 34.3 | n.d. | 46.2 | n.d. | 58.8 | n.d. | 1 |
| R338E/R403E/E410N | R170E/R233E/E240N | 35.6 | n.d. | 46.6 | n.d. | 57.1 | n.d. | 1 |
| Y155F/R338E/R403E/E410N | Y[155]F/R170E/R233E/E240N | 31.1 | n.d. | 41.2 | n.d. | 52.6 | n.d. | 1 |
| R318Y/R338E/R403E | R150Y/R170E/R233E | 41.7 | n.d. | 52.7 | n.d. | 68.4 | n.d. | 1 |
| Y155F/R318Y/R338E/R403E | Y[155]F/R150Y/R170E/R233E | 38.6 | n.d. | 48.6 | n.d. | 64.1 | n.d. | 1 |
| R318Y/R338E/E410N | R150Y/R170E/E240N | 21.2 | n.d. | 24.8 | n.d. | 34.3 | n.d. | 1 |
| D104N/K106S/R318Y/R338E/E410N | D[104]N/K[106]S/R150Y/R170E/E240N | 24.5 | n.d. | 30.8 | n.d. | 40.0 | n.d. | 1 |
| R318Y/R403E/E410N | R150Y/R233E/E240N | 46.1 | n.d. | 61.7 | n.d. | 78.3 | n.d. | 1 |
| Y155F/R318Y/R403E/E410N | Y[155]F/R150Y/R233E/E240N | 42.3 | n.d. | 57.1 | n.d. | 74.5 | n.d. | 1 |
| R318Y/R338E/R403E/E410N | R150Y/R170E/R233E/E240N | 25.4 | 1.2 | 33.0 | 2.1 | 43.0 | 1.1 | 3 |
| T343R | T175R | 41.3 | 2.1 | 53.3 | 2.9 | 67.2 | 6.2 | 2 |
| T343R/Y345T | T175R/Y177T | 46.8 | 2.8 | 56.3 | 9.6 | 75.5 | 1.8 | 2 |
| R318Y/R338E | R150Y/R170E | 26.7 | n.d. | 31.5 | n.d. | 45.3 | n.d. | 1 |
| Y155F/K228N/R318Y/R338E/R403E/E410N | Y[155]F/K63N/R150Y/R170E/R233E/E240N | 35.6 | n.d. | 45.1 | n.d. | 60.1 | n.d. | 1 |
| D104N/K106S/I251S/R318Y/R338E/R403E/E410N | D[104]N/K[106]S/I86S/R150Y/R170E/R233E/E240N | 36.0 | n.d. | 46.8 | n.d. | 61.8 | n.d. | 1 |
| I251S/R318Y/R338E/E410N | I86S/R150Y/R170E/E240N | 28.0 | n.d. | 30.1 | n.d. | 40.7 | n.d. | 1 |
| D104N/K106S/I251S/R318Y/R338E/E410N | D[104]N/K[106]S/I86S/R150Y/R170E/E240N | 25.0 | n.d. | 31.0 | n.d. | 43.1 | n.d. | 1 |
| K247N/N249S/R318Y/R338E/R403E/E410N | K82N/N84S/R150Y/R170E/R233E/E240N | 33.7 | n.d. | 43.8 | n.d. | 58.4 | n.d. | 1 |
| Y155F/K247N/N249S/R318Y/R338E/R403E/E410N | Y[155]F/K82N/N84S/R150Y/R170E/R233E/E240N | 34.1 | n.d. | 46.2 | n.d. | 62.4 | n.d. | 1 |
| A103N/N105S/K247N/N249S/R318Y/R338E/R403E/E410N | A[103]N/N[105]S/K82N/N84S/R150Y/R170E/R233E/E240N | 36.1 | n.d. | 48.1 | n.d. | 62.6 | n.d. | 1 |
| D104N/K106S/Y155F/K247N/N249S/R318Y/R338E/R403E/E410N | D[104]N/K[106]S/Y[155]F/K82N/N84S/R150Y/R170E/R233E/E240N | 34.8 | n.d. | 45.6 | n.d. | 59.3 | n.d. | 1 |
| K247N/N249S/R318Y/R338E/E410N | K82N/N84S/R150Y/R170E/E240N | 26.1 | n.d. | 34.3 | n.d. | 44.7 | n.d. | 1 |
| Y155F/K247N/N249S/R318Y/R338E/E410N | Y[155]F/K82N/N84S/R150Y/R170E/E240N | 24.0 | n.d. | 29.2 | n.d. | 41.1 | n.d. | 1 |
| R318Y/R338E/R403E/E410S | R150Y/R170E/R233E/E240S | 26.9 | n.d. | 34.7 | n.d. | 47.0 | n.d. | 1 |

TABLE 32-continued

Clotting Activity (aPTT) of FIX Variants in Hemophilia B Plasma

| Mutation (Mature FIX Numbering) | Mutation (Chymotrypsin Numbering) | aPTT (100 nM) (s) | ±S.D. | aPTT (10 nM) (s) | ±S.D. | aPTT (1.0 nM) (s) | ±S.D. | n |
|---|---|---|---|---|---|---|---|---|
| K228N/K247N/N249S | K63N/K82N/N84S | 44.4 | n.d. | 57.2 | n.d. | 70.2 | n.d. | 1 |
| D104N/K106S/Y155F/ K228N/K247N/N249S | D[104]N/K[106]S/Y[155]F/ K63N/K82N/N84S | 46.9 | n.d. | 60.0 | n.d. | 73.6 | n.d. | 1 |
| K228N/K247N/N249S/ R318Y/R338E/R403E/ E410N | K63N/K82N/N84S/ R150Y/R170E/R233E/ E240N | 35.3 | 5.1 | 46.1 | 8.0 | 60.6 | 8.9 | 2 |
| D104N/K106S/K228N/ K247N/N249S/R318Y/ R338E/R403E/E410N | D[104]N/K[106]S/K63N/ K82N/N84S/R150Y/ R170E/R233E/E240N | 38.4 | n.d. | 50.1 | n.d. | 67.1 | n.d. | 1 |
| Y155F/K228N/K247N/ N249S/R318Y/R338E/ R403E/E410N | Y[155]F/K63N/K82N/ N84S/R150Y/R170E/ R233E/E240N | 34.9 | n.d. | 44.7 | n.d. | 59.1 | n.d. | 1 |
| R318Y/R338E/R403E/ E410N/T412V | R150Y/R170E/R233E/ E240N/T242V | 28.7 | n.d. | 37.6 | n.d. | 47.6 | n.d. | 1 |
| R318Y/R338E/R403E/ E410N/T412A | R150Y/R170E/R233E/ E240N/T242A | 30.5 | n.d. | 40.6 | n.d. | 52.8 | n.d. | 1 |
| R318Y/R338E/E410N/ T412V | R150Y/R170E/E240N/ T242V | 25.5 | n.d. | 30.7 | n.d. | 40.3 | n.d. | 1 |
| R318Y/R338E/N346D/ R403E/E410N | R150Y/R170E/N178D/ R233E/E240N | 42.5 | n.d. | 54.2 | n.d. | 68.9 | n.d. | 1 |
| Y155F/R318Y/R338E/ N346D/R403E/E410N | Y[155]F/R150Y/R170E/ N178D/R233E/E240N | 37.8 | n.d. | 48.9 | n.d. | 65.2 | n.d. | 1 |
| K247N/N249S/N260S/ R318Y/R338E/R403E/ E410N | K82N/N84S/N95S/ R150Y/R170E/R233E/ E240N | 44.7 | n.d. | 56.9 | n.d. | 75.7 | n.d. | 1 |
| Y155F/K247N/N249S/ N260S/R318Y/R338E/ R403E/E410N | Y[155]F/K82N/N84S/N95S/ R150Y/R170E/R233E/ E240N | 49.3 | n.d. | 59.6 | n.d. | 75.5 | n.d. | 1 |
| R318Y/R338E/T343R/ R403E/E410N | R150Y/R170E/T175R/R233E/ E240N | 23.7 | 2.7 | 29.7 | 3.3 | 39.7 | 6.5 | 4 |
| Y155F/R318Y/R338E/ T343R/R403E/E410N | Y[155]F/R150Y/R170E/ T175R/R233E/E240N | 26.2 | 3.6 | 32.0 | 3.9 | 42.4 | 1.8 | 2 |
| D104N/K106S/R318Y/ R338E/T343R/R403E/ E410N | D[104]N/K[106]S/R150Y/ R170E/T175R/R233E/ E240N | 27.3 | n.d. | 34.9 | n.d. | 48.0 | n.d. | 1 |
| R338E/T343R | R170E/T175R | 27.9 | n.d. | 33.8 | n.d. | 45.1 | n.d. | 1 |
| T343R/N346Y | T175R/N178Y | 40.8 | 3.8 | 54.9 | 0.8 | 74.9 | 2.2 | 2 |
| R318Y/R338E/N346Y/ R403E/E410N | R150Y/R170E/N178Y/ R233E/E240N | 28.8 | n.d. | 41.0 | n.d. | 54.4 | n.d. | 1 |
| R318Y/R338E/T343R/ N346Y/R403E/E410N | R150Y/R170E/T175R/N178Y/ R233E/E240N | 24.5 | n.d. | 32.5 | n.d. | 41.7 | n.d. | 1 |
| T343R/N346D | T175R/N178D | 39.9 | 1.4 | 51.3 | 4.8 | 65.0 | 4.1 | 2 |
| R318Y/R338E/T343R/ N346D/R403E/E410N | R150Y/R170E/T175R/ N178D/R233E/E240N | 34.8 | n.d. | 45.1 | n.d. | 57.9 | n.d. | 1 |
| R318Y/R338E/Y345A/ R403E/E410N | R150Y/R170E/Y177A/ R233E/E240N | 41.2 | n.d. | 47.9 | n.d. | 61.9 | n.d. | 1 |
| Y155F/K247N/N249S/ R318Y/R338E/R403E | Y[155]F/K82N/N84S/ R150Y/R170E/R233E | 40.2 | n.d. | 51.6 | n.d. | 62.2 | n.d. | 1 |
| K247N/N249S/R318Y/ R338E/R403E | K82N/N84S/R150Y/ R170E/R233E | 42.0 | n.d. | 55.6 | n.d. | 70.3 | n.d. | 1 |
| K247N/N249S/R318Y/ R403E/E410N | K82N/N84S/R150Y/ R233E/E240N | 44.6 | 3.0 | 57.2 | 4.2 | 71.5 | 6.1 | 3 |
| Y155F/K247N/N249S/ R338E/R403E/E410N | Y[155]F/K82N/N84S/ R170E/R233E/E240N | 31.0 | n.d. | 42.1 | n.d. | 55.6 | n.d. | 1 |
| K247N/N249S/R338E/ R403E/E410N | K82N/N84S/R170E/ R233E/E240N | 32.7 | n.d. | 42.2 | n.d. | 56.2 | n.d. | 1 |
| R318Y/R338E/T343R/ R403E | R150Y/R170E/T175R/ R233E | 30.1 | n.d. | 37.9 | n.d. | 51.4 | n.d. | 1 |
| Y155F/R318Y/R338E/ T343R/R403E | Y[155]F/R150Y/R170E/ T175R/R233E | 32.0 | n.d. | 41.5 | n.d. | 53.7 | n.d. | 1 |
| R318Y/R338E/T343R/ E410N | R150Y/R170E/T175R/E240N | 24.7 | 2.9 | 27.2 | 2.9 | 36.5 | 3.8 | 5 |
| Y155F/R318Y/R338E/ T343R/E410N | Y[155]F/R150Y/R170E/ T175R/E240N | 25.9 | 2.1 | 28.8 | 3.5 | 38.5 | 4.2 | 2 |
| R318Y/T343R/R403E/ E410N | R150Y/T175R/R233E/ E240N | 31.7 | n.d. | 43.3 | n.d. | 60.7 | n.d. | 1 |
| Y155F/R318Y/T343R/ R403E/E410N | Y[155]F/R150Y/T175R/ R233E/E240N | 40.3 | n.d. | 52.0 | n.d. | 68.7 | n.d. | 1 |
| R338E/T343R/R403E/ E410N | R170E/T175R/R233E/ E240N | 25.5 | n.d. | 30.4 | n.d. | 41.9 | n.d. | 1 |

TABLE 32-continued

Clotting Activity (aPTT) of FIX Variants in Hemophilia B Plasma

| Mutation (Mature FIX Numbering) | Mutation (Chymotrypsin Numbering) | aPTT (100 nM) (s) | ±S.D. | aPTT (10 nM) (s) | ±S.D. | aPTT (1.0 nM) (s) | ±S.D. | n |
|---|---|---|---|---|---|---|---|---|
| Y155F/R338E/T343R/R403E/E410N | Y[155]F/R170E/T175R/R233E/E240N | 27.5 | n.d. | 33.3 | n.d. | 42.3 | n.d. | 1 |
| Y155F/K247N/N249S/R318Y/R338E/T343R/R403E/E410N | Y[155]F/K82N/N84S/R150Y/R170E/T175R/R233E/E240N | 24.2 | 0.9 | 29.7 | 1.4 | 40.5 | 2.4 | 5 |
| K247N/N249S/R318Y/R338E/T343R/R403E/E410N | K82N/N84S/R150Y/R170E/T175R/R233E/E240N | 28.7 | n.d. | 36.2 | n.d. | 50.2 | n.d. | 1 |
| K228N/I251S/R318Y/R338E/R403E/E410N | K63N/I86S/R150Y/R170E/R233E/E240N | 34.5 | n.d. | 44.9 | n.d. | 58.2 | n.d. | 1 |
| Y155F/K228N/I251S/R318Y/R338E/R403E/E410N | Y[155]F/K63N/I86S/R150Y/R170E/R233E/E240N | 34.5 | n.d. | 46.5 | n.d. | 60.3 | n.d. | 1 |
| N260S/R318Y/R338E/T343R/R403E/E410N | N95S/R150Y/R170E/T175R/R233E/E240N | 31.4 | n.d. | 41.1 | n.d. | 55.4 | n.d. | 1 |
| Y155F/N260S/R318Y/R338E/T343R/R403E/E410N | Y[155]F/N95S/R150Y/R170E/T175R/R233E/E240N | 35.3 | 0.6 | 45.3 | 2.5 | 59.1 | 3.2 | 2 |
| K228N/K247N/N249S/R318Y/R338E/T343R/R403E/E410N | K63N/K82N/N84S/R150Y/R170E/T175R/R233E/E240N | 28.0 | 2.0 | 35.5 | 3.9 | 47.7 | 6.0 | 8 |
| Y155F/K228N/K247N/N249S/R318Y/R338E/T343R/R403E/E410N | Y[155]F/K63N/K82N/N84S/R150Y/R170E/T175R/R233E/E240N | 30.7 | 2.3 | 40.6 | 2.0 | 53.5 | 2.5 | 2 |
| Y155F/R338E/T343R/R403E | Y[155]F/R170E/T175R/R233E | 29.8 | n.d. | 37.9 | n.d. | 50.1 | n.d. | 1 |
| R338E/T343R/R403E | R170E/T175R/R233E | 29.4 | n.d. | 37.0 | n.d. | 49.8 | n.d. | 1 |
| Y155F/R338E/T343R/R403E/E410S | Y[155]F/R170E/T175R/R233E/E240S | 28.3 | n.d. | 33.3 | n.d. | 44.4 | n.d. | 1 |
| Y155F/N260S/R338E/T343R/R403E | Y[155]F/N95S/R170E/T175R/R233E | 40.5 | n.d. | 52.9 | n.d. | 70.1 | n.d. | 1 |
| Y155F/I251S/R338E/T343R/R403E | Y[155]F/I86S/R170E/T175R/R233E | 31.9 | n.d. | 40.1 | n.d. | 54.5 | n.d. | 1 |
| R318Y/R338E/T343R/R403E/E410S | R150Y/R170E/T175R/R233E/E240S | 27.4 | n.d. | 34.0 | n.d. | 43.3 | n.d. | 1 |
| Y155F/K247N/N249S/T343R/R403E | Y[155]F/K82N/N84S/T175R/R233E | 43.2 | n.d. | 58.6 | n.d. | 74.2 | n.d. | 1 |
| Y155F/K247N/N249S/R318Y/R338E/T343R/R403E | Y[155]F/K82N/N84S/R150Y/R170E/T175R/R233E | 32.5 | n.d. | 41.4 | n.d. | 55.4 | n.d. | 1 |
| K247N/N249S/R318Y/R338E/T343R/R403E | K82N/N84S/R150Y/R170E/T175R/R233E | 30.8 | 4.2 | 39.1 | 6.9 | 52.5 | 9.1 | 2 |
| Y155F/K247N/N249S/R338E/T343R/R403E/E410N | Y[155]F/K82N/N84S/R170E/T175R/R233E/E240N | 27.3 | n.d. | 34.9 | n.d. | 47.7 | n.d. | 1 |
| K247N/N249S/R338E/T343R/R403E/E410N | K82N/N84S/R170E/T175R/R233E/E240N | 28.2 | n.d. | 35.1 | n.d. | 47.3 | n.d. | 1 |
| Y155F/K247N/N249S/R318Y/R338E | Y[155]F/K82N/N84S/R150Y/R170E | 29.6 | n.d. | 37.4 | n.d. | 48.7 | n.d. | 1 |
| Y155F/K247N/N249S/R318Y/T343R | Y[155]F/K82N/N84S/R150Y/T175R | 39.6 | n.d. | 49.7 | n.d. | 65.0 | n.d. | 1 |
| Y155F/K247N/N249S/R318Y/R403E | Y[155]F/K82N/N84S/R150Y/R233E | 52.2 | n.d. | 67.9 | n.d. | 79.9 | n.d. | 1 |
| Y155F/K247N/N249S/R318Y/E410N | Y[155]F/K82N/N84S/R150Y/E240N | 32.9 | n.d. | 43.8 | n.d. | 55.8 | n.d. | 1 |
| Y155F/K247N/N249S/R338E/R403E | Y[155]F/K82N/N84S/R170E/R233E | 39.2 | n.d. | 50.4 | n.d. | 62.6 | n.d. | 1 |
| Y155F/K247N/N249S/R338E/T343R | Y[155]F/K82N/N84S/R170E/T175R | 27.4 | n.d. | 31.5 | n.d. | 41.8 | n.d. | 1 |
| Y155F/K247N/N249S/R318Y/R338E/T343R/E410N | Y[155]F/K82N/N84S/R150Y/R170E/T175R/E240N | 28.7 | 0.4 | 32.7 | 0.1 | 41.8 | 0.9 | 2 |
| K247N/N249S/R318Y/R338E/T343R/E410N | K82N/N84S/R150Y/R170E/T175R/E240N | 28.0 | 0.8 | 32.7 | 0.8 | 42.4 | 0.3 | 2 |
| Y155F/K247N/N249S/R318Y/T343R/R403E/E410N | Y[155]F/K82N/N84S/R150Y/T175R/R233E/E240N | 38.9 | n.d. | 50.4 | n.d. | 65.5 | n.d. | 1 |
| K247N/N249S/R318Y/T343R/R403E/E410N | K82N/N84S/R150Y/T175R/R233E/E240N | 35.9 | 4.2 | 46.6 | 6.0 | 60.9 | 7.8 | 2 |

TABLE 32-continued

Clotting Activity (aPTT) of FIX Variants in Hemophilia B Plasma

| Mutation (Mature FIX Numbering) | Mutation (Chymotrypsin Numbering) | aPTT (100 nM) (s) | ±S.D. | aPTT (10 nM) (s) | ±S.D. | aPTT (1.0 nM) (s) | ±S.D. | n |
|---|---|---|---|---|---|---|---|---|
| Y155F/K247N/N249S/R338E/E410N | Y[155]F/K82N/N84S/R170E/E240N | 27.1 | 1.9 | 31.8 | 2.0 | 41.2 | 0.8 | 2 |
| Y155F/K247N/N249S/R318Y/T343R/R403E | Y[155]F/K82N/N84S/R150Y/T175R/R233E | 44.3 | n.d. | 60.7 | n.d. | 75.5 | n.d. | 1 |
| K247N/N249S/R318Y/T343R/R403E | K82N/N84S/R150Y/T175R/R233E | 45.3 | n.d. | 57.5 | n.d. | 75.7 | n.d. | 1 |
| Y155F/K247N/N249S/R318Y/T343R/E410N | Y[155]F/K82N/N84S/R150Y/T175R/E240N | 44.9 | 0.1 | 52.5 | 3.7 | 64.9 | 0.5 | 2 |
| K247N/N249S/R318Y/T343R/E410N | K82N/N84S/R150Y/T175R/E240N | 42.7 | n.d. | 50.2 | n.d. | 64.6 | n.d. | 1 |
| Y155F/K247N/N249S/R338E/T343R/R403E | Y[155]F/K82N/N84S/R170E/T175R/R233E | 31.1 | n.d. | 40.9 | n.d. | 56.2 | n.d. | 1 |
| K247N/N249S/R338E/T343R/R403E | K82N/N84S/R170E/T175R/R233E | 32.0 | n.d. | 43.2 | n.d. | 56.1 | n.d. | 1 |
| Y155F/K247N/N249S/R338E/T343R/E410N | Y[155]F/K82N/N84S/R170E/T175R/E240N | 28.5 | n.d. | 32.2 | n.d. | 45.9 | n.d. | 1 |
| K247N/N249S/R338E/T343R/E410N | K82N/N84S/R170E/T175R/E240N | 25.1 | 3.9 | 29.9 | 5.0 | 41.1 | 8.0 | 2 |
| Y155F/K247N/N249S/T343R/R403E/E410N | Y[155]F/K82N/N84S/T175R/R233E/E240N | 36.7 | n.d. | 49.3 | n.d. | 65.4 | n.d. | 1 |
| Y155F/R318Y/R338E/T343R | Y[155]F/R150Y/R170E/T175R | 27.4 | 1.0 | 31.4 | 1.7 | 40.7 | 0.4 | 2 |
| R318Y/R338E/T343R | R150Y/R170E/T175R | 20.5 | n.d. | 24.3 | n.d. | 32.2 | n.d. | 1 |
| Y155F/R318Y/T343R/R403E | Y[155]F/R150Y/T175R/R233E | 43.4 | n.d. | 56.1 | n.d. | 71.3 | n.d. | 1 |
| Y155F/T343R/R403E/E410N | Y[155]F/T175R/R233E/E240N | 36.1 | n.d. | 47.5 | n.d. | 63.0 | n.d. | 1 |
| Y155F/K247N/N249S/R318Y/R338E/T343R | Y[155]F/K82N/N84S/R150Y/R170E/T175R | 28.0 | 1.4 | 32.9 | 0.8 | 42.6 | 0.4 | 2 |
| K247N/N249S/R318Y/R338E/T343R | K82N/N84S/R150Y/R170E/T175R | 27.4 | 1.2 | 32.7 | 0.2 | 42.4 | 3.1 | 2 |
| Y155F/K247N/N249S/T343R/E410N | Y[155]F/K82N/N84S/T175R/E240N | 36.2 | 4.5 | 44.8 | 5.9 | 54.4 | 4.2 | 5 |
| Y155F/K247N/N249S/R403E/E410N | Y[155]F/K82N/N84S/R233E/E240N | 47.2 | n.d. | 60.7 | n.d. | 74.2 | n.d. | 1 |
| Y155F/R338E/T343R/E410N | Y[155]F/R170E/T175R/E240N | 24.9 | 4.4 | 27.5 | 4.4 | 34.9 | 4.4 | 4 |
| R338E/T343R/E410N | R170E/T175R/E240N | 19.8 | n.d. | 23.9 | n.d. | 34.7 | n.d. | 1 |
| Y155F/R318Y/T343R/E410N | Y[155]F/R150Y/T175R/E240N | 41.3 | 5.7 | 49.5 | 6.0 | 63.4 | 6.0 | 2 |
| R318Y/T343R/E410N | R150Y/T175R/E240N | 34.5 | n.d. | 44.8 | n.d. | 61.0 | n.d. | 1 |
| K228N/R318Y/R338E/T343R/R403E/E410N | K63N/R150Y/R170E/T175R/R233E/E240N | 23.4 | n.d. | 28.8 | n.d. | 38.9 | n.d. | 1 |
| K228N/K247N/N249S/R318Y/R338E/T343R/R403E | K63N/K82N/N84S/R150Y/R170E/T175R/R233E | 28.6 | n.d. | 37.3 | n.d. | 47.9 | n.d. | 1 |
| K228N/247N/N249S/R318Y/R338E/T343R/E410N | K63N/K82N/N84S/R150Y/R170E/T175R/E240N | 21.4 | n.d. | 25.8 | n.d. | 34.3 | n.d. | 1 |
| K228N/K247N/N249S/R318Y/T343R/R403E/E410N | K63N/K82N/N84S/R150Y/T175R/R233E/E240N | 35.4 | n.d. | 44.0 | n.d. | 61.4 | n.d. | 1 |

Since modifications will be apparent to those of skill in this art, it is intended that this invention be limited only by the scope of the appended claims.

SEQUENCE LISTING (417 sequences)

SEQ ID NO: 1 - DNA, 1383 bp, Homo sapiens
  Factor IX mRNA
atgcagcgcgtgaacatgatcatggcagaatcaccaggcctcatcaccatctgccttttaggatatctactcagtgctgaatgtacagtttttcttgatcatgaaaacgccaacaaaattctgaatcggccaaagaggtataattcaggtaaattggaagagtttgttcaagggaaccttgagagagaatgtatggaagaaaagtgtagttttgaagaagcacgagaagtttttgaaaacactgaaagaacaactgaattttggaagcagtatgttgatggagatcagtgtgagtccaatccatgtttaaatggcggcagttgcaaggatgacattaattcctatgaatgttggtgtccctttggatttgaaggaaagaactgtgaattagatgtaacatgtaacattaagaatggcagatgcgagcagttttgtaaaaatagtgctgataacaaggtggtttgctcctgtactgagggatatcgacttgcagaaaaccagaagtcctgtgaaccagcagtgccatttccatgtggaagagtttctgtttcacaaacttctaagctcacccgtgctgagactgtttttcctgatgtggactatgtaaattctactgaagctgaaaccattttggataacatcactcaaagcacccaatcatttaatgacttcactcgggttgttggtggagaagatgccaaaccaggtcaattcccttggcaggttgttttgaatggtaaagttgatgcattctgtggaggctctatcgttaatgaaaaatggattgtaactgctgcccactgtgttgaaactggtgttaaaattacagttgtcgcaggtgaacataatattgaggagacagaacatacagagcaaaagcgaaatgtgattcgaattattcctcaccacaactacaatgcagctattaataagtacaaccatgacattgcccttctggaactggacgaacccttagtgctaaacagctacgttacacctatttgcattgctgacaaggaatacacgaacatcttcctcaaatttggatctggctatgtaagtggctggggaagagtcttccacaaagggagatcagctttagttcttcagtaccttagagttccacttgttgaccgagccacatgtcttcgatctacaaagttcaccatctataacaacatgttctgtgctggcttccatgaaggaggtagagattcatgtcaaggagatagtgggggaccccatgttactgaagtggaagggaccagtttcttaactggaattattagctggggtgaagagtgtgcaatgaaaggcaaatatggaatatataccaaggtatcccggtatgtcaactggattaaggaaaaaacaaagctcact

SEQ ID NO: 2 - protein, 461 aa, Homo sapiens
  Precursor Factor IX
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 3 - protein, 415 aa, Homo sapiens
  Mature Factor IX
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 4 - protein, 461 aa, Pan troglodytes
  Chimpanzee Factor IX
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVDTGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 5 - protein, 461 aa, Macaca mulatta
  Rhesus macaque Factor IX
MQRVNMIMAESPGLITICLLGYLLSAECTVFLDHENANKILNRPKRYNSGKLEEFVQGNLERECMEEKCNFEEAREVFENTEKTTEFWKQYVDGDQCESNPCLNGGSCKDDINSYECWCPFGFEGKNCELDVTCNIKNGRCKQFCKNTADNKVVCSCTEGYRLAENQRSCEPAVPFPCGRVSVSQTSTLTRAETVFPDVEYVNSTEAETILDNITQSTQSFNDFTRVVGGEDAKPGQFPWQVVLNGKVDAFCGGSIVNEKWVVTAAHCVETDAKITVVAGEHNIEETEHTEQKRNVIRIIPHHNYNATINKYNHDIALLELDEPLVLNSYVTPICIADKEYTNIFLKFGSGYVSGWGRVFNKGRSASVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 6 - protein, 471 aa, Mus musculus
  Mouse Factor IX
MKHLNTVMAESPALITIFLLGYLLSTECAVFLDRENATKILTRPKRYNSGKLEEFVRGNLERECIEERCSFEEAREVFENTEKTTEFWKQYVDGDQCESNPCLNGGICKDDISSYECWCQVGFEGRNCELDATCNIKNGRCKQFCKNSPDNKVICSCTEGYQLAEDQKSCEPTVPFPCGRASISYSSKKITRAETVFSNMDYENSTEAVFIQDDITDGAILNNVTESSESLNDFTRVVGGENAKPGQIPWQVILNGEIEAFCGGAIINEKWIVTAAHCLKPGDKIEVVAGEYNIDKKEDTEQRRNVIRTIPHHQYNATINKYSHDIALLELDKPLILNSYVTPICVANREYTNIFLKFGSGYVSGWGKVFNKGRQASILQYLRVPLVDRATCLRSTTFTIYNNMFCAGYREGGKDSCEGDSGGPHVTEVEGTSFLTGIISWGEECAMKGKYGIYTKVSRYVNWIKEKTKLT

SEQ ID NO: 7 - protein, 282 aa, Rattus norvegicus
  Rat Factor IX
RVSVAYNSKKITRAETVFSNTDYGNSTELILDDITNSTILDNLTENSEPINDFTRVVGGENAKPGQIPWQVILNGEIEAFCGGAIINEKWIVTAAHCLKPGDKIEVVAGEHNIDEKEDTEQRRNVIRTIPHHQYNATINKYSHDIALLELDKPLILNSYVTPICVANKEYTNIFLKFGSGYVSGWGKVFNKGRQASILQYLRVPLVDRATCLRSTKFSIYNNMFCAGYREGGKDSCEGDSGGPHVTEVEGTSFLTGIISWGEECAMKGKYGIYTKVSRYVNW

SEQ ID NO: 8 - protein, 285 aa, Cavia porcellus
  Guinea pig Factor IX
RVSIPSVSKEHNRANAIFSRMGYVNFTDDETIWDDNDDDETIWDNSTESTKPSDEFFRVVGGEDAKPGQFPWQVLLNGETEAFCGGSIVNEKWIVTAAHCILPGIKIEVVAGKHNIEKKEDTEQRRNVTQIILHHSYNASFNKYSHDIALLELDKPLSLNSYVTPICIANREYTNIFLKFGAGYVSGWGKLFSQGRTASILQYLRVPLVDRATCLRSTKFTIYNNMFCAGFHEGGRDSCQGDSGGPHVTEVEGTNFLTGIISWGEECAMKGKYGIYTKVSRYVNW

SEQ ID NO: 9 - protein, 409 aa, Sus scrofa
  Pig Factor IX
YNSGKLEESFVRGNLERECIEEKCSFEEAREVFENTEKTNEFWKQYVDGDQCEPNPCLNGGLCKDDINSYECWCQVGFEGKNCELDATCNIKNGRCKQFCKTGADSKVLCSCTTGYRLAPDQKSCKPAVPFPCGRVSVSHSPTTLTRAEIIFSNMDYENSTEVEPILDSLTESNQSSDDFIRIVGGENAKPGQFPWQVLLNGKIDAFCGGSIINEKWVVTAAHCIEPGVKITVVAGEYNTEETEPTEQRRNVIRAIPHHSYNATVNKYSHDIALLELDEPLTLNSYVTPICIADKEYTNIFLKFGSGYVSGWGRVFNRGRSATILQYLKVPLVDRATCLRSTKVTIYSNMFCAGFHEGGKDSCLGDSGGPHVTEVEGTSFLTGIISWGEECAVKGKYGIYTKVSRYVNW

SEQ ID NO: 10 - protein, 452 aa, Canis familiaris
  Dog Factor IX
MAEASGLVTVCLLGYLLSAECAVFLDRENATKILSRPKRYNSGKLEEFVRGNLERECIEEKCSFEEAREVFENTEKTTEFWKQYVDGDQCESNPCLNDGVCKDDINSYECWCRAGFEGKNCELDVTCNIKNGRCKQFCKLGPDNKVVCSCTTGYQLAEDQRSCEPAVPFPCGRVSVPHISMTRTRAETLFSNMDYENSTEVEKILDNVTQPLNDFTRVVGGKDAKPGQFPWQVLLNGKVDAFCGGSIINEKWVVTAAHCIEPDVKITIVAGEHNTEKREHTEQKRNVIRTILHHSYNATINKYNHDIALLELDEPLTLNSYVTPICIADREYSNIFLKFGSGYVSGWGRVFNKGRSASILQYLKVPLVDRATCLRSTKFTIYNNMFCAGFHEGGKDSCQGDSGGPHVTEVEGISFLTGIISWGEECAMKGKYGIYTKVSRYVNWIKEKTKLT

SEQ ID NO: 11 - protein, 466 aa, Felis catus
  Cat Factor IX
MRCLNMIMAEPPGLITICLLGYLLGADCTVFLDHEDATKVLSRPKRYNSGKLEEFVQGNLERECMEEKCSFEEAREVFENTEKTTEFWKQYVDGDQCESNPCLNGGICKDDINSYECWCQTGFEGKNCELDVTCNIKNGRCKQFCKLDADNKVVCSCTTGYQLAEDQKSCEPAVPFPCGRVSVPHISTTHTRAETLFLNMDYENSTTDYENSAEAEKNVDNVTQPLNDLTRIVGGKTAKPGQFPWQVLLKGKIDAFCGGSIINEKWVVTAAHCINPDVEITVVAGEHNTEETEHTEQKRNVIRTILHHSYNASVNKYSHDIALLELDEPLTLNSYVTPICVADREYTNTFLKFGYGYVSGWGKVFNKGRPATILQYLKVPLVDRATCLRSTKFTIYNNMFCAGFHEGGKDSCQGDSGGPHVTEVEGINFLTGIISWGEECAMKGKYGIYTKVSRYVNWIKEKTKLT

SEQ ID NO: 12 - protein, 275 aa, Oryctolagus cuniculus
  Rabbit Factor IX
GVSVSHASKKITRATTIFSNTEYENFTEAETIRGNVTQRSQSSDDFTRIVGGENAKPGQFPWQVLLNGKVEAFCGGSIINEKWVVTAAHCIKPDDNITVVAGEYNIQETENTEQKRNVIRIIPYHKYNATINKYNHDIALLELDKPLTLNSYVTPICIANREYTNIFLNFGSGYVSGWGRVFNRGRQASILQYLRVPFVDRATCLRSTKFTIYNNMFCAGFDVGGKDSCEGDSGGPHVTEVEGTSFLTGIISWGEECAIKGKYGVYTRVSWYVNW

SEQ ID NO: 13 - protein, 471 aa, Gallus gallus
  Chicken Factor IX
MAKIPLILSFCLLEAFLGAESTVFIENKEASTVLSRTRRGNSNRLEELIPGNLERECIEEKCSFEEAREVFENTEKTMEFWKIYIDGDQCNSNPCKNGAVCKDGVSSYECMCPPGYGGRNCEIDSTCATKNGGCEHFCRHDTPQKAVCSCASGYKLHEDGKSCKPAVPYPCGRITAPEMRGKVTRTENTIERWNITAHDEGDAHDEALDITEPPPPPTTSAAPAKIVPITKNDTRVVGGYDSVKGQLPWQVHLVDSRGLGFCGGSIINEKWVVTAAHCLEPGDNVTAVAGEYNTKEDDHTEQRRQVVKILPYPTYNRTRNKHHNDIALLELDQPLTFNSYVTPICIGSRDFTNNLLSNGPGTVSGWGSMLYRGRSAIVLQVLTVPFVDRVTCLKSTSTTILHSMFCAGYTAGGKDTCGGDSGGPYTNSIGETWFLTGVTSWGEECAKPGKYGIYTKVAKYVKWIRETTRLT

SEQ ID NO: 14 - protein, 416 aa, Bos taurus
  Cow Factor IX
YNSGKLEEFVRGNLERECKEEKCSFEEAREVFENTEKTTEFWKQYVDGDQCESNPCLNGGMCKDDINSYECWCQAGFEGTNCELDATCSIKNGRCKQFCKRDTDNKVVCSCTDGYRLAEDQKSCEPAVPFPCGRVSVSHISKKLTRAETIFSNTNYENSSEAEIIWDNVTQSNQSFDEFSRVVGGEDAERGQFPWQVLLHGEIAAFCGGSIVNEKWVVTAAHCIKPGVKITVVAGEHNTEKPEPTEQKRNVIRAIPYHSYNASINKYSHDIALLELDEPLELNSYVTPICIADRDYTNIFSKFGYGYVSGWGKVFNRGRSASILQYLKVPLVDRATCLRSTKFSIYSHMFCAGYHEGGKDSCQGDSGGPHVTEVEGTSFLTGIISWGEECAMKGKYGIYTKVSRYVNWIKEKTKLT

SEQ ID NO: 15 - protein, 274 aa, Ovis aries
  Sheep Factor IX
RASVLHTSKKLTRAETIFSNMNYENSSEAEIIWDNVTQSNQSFDDFNRVVGGEDAARGQFPWQVLLHGEIAAFCGGSIVNEKWVVTAAHCIKPGVKITVVAGEHNTEKPEPTEQKRNVIRAIPYHGYNASINKYSHDIALLELDEPLELNSYVTPICIADREYTNIFLKFGYGYVSGWGRVFNRGRSASILQYLKVPLVDRATCLRSTKFTIYNHMFCAGYHEGGKDSCQGDSGGPHVTEVEGTSFLTGIISWGEECAMKGKYGIYTKVSRYEV

SEQ ID NO: 16 - protein, 463 aa, Xenopus tropicalis
  Frog Factor IX
MVAFSSILIIYLLTSLCSTEKAVFLSDESASSLLVRQKRYNTGRLEEWVAGNLERECLEEKCNYEEAREVFENDDKTKEFWKQYIDGDQCLSNPCLNGGVCKDDVSDYVCWCQQGYSGKNCELELPVICSIMNGGCDHMCRDDPVKKVICSCASGYKLAENGKTCEAAVPYPCGRVSSPEALPKEETRSFLDSLEQNLTSAAHPNITDQEKPKEDIVPVTVDPNVRIVGGTDSLKGEFPWQVHLVNKDNLGFCSGSIINEKWIVTAAHCFLIRGEFKVVAGEHNTEVSDGTEQHHKVTRIILYPAYNATRSKYNNDIALLELEKPLELNDYVRPVCIGNMDFTEKLLKRNAFSMVSGWGDLGYKGRPAVILQKLAVPYINQAACKKSSRFSIYANMFCAGYSDESKDTCQGDSGGPHVTEYKNLWFLTGITSWGEKCAEKDKYGVYTRLSRFTDWIRTTTKIS

SEQ ID NO: 17 - protein, 503 aa, Danio rerio
  Zebrafish Factor IX
MASFILVLFPFLLLQAALGSVFLDGEKADSVLWRRRRANTWLFEEFLPGNVERECIEEKCVLEEAREAFENDEKTMEFWASYVDGNQCKPSPCQNQGTCEDQMGTYSCNCLARFCWQNCEIVTAKKCDVDNGGCEHFCVLLESHKTQCRVHMDTNSQKMDFTCEPIVKFPCGKTSKPAVKTFGTASVTNTTAQSSNKTIKSTSSIPKPDNLTNPTNSKDIKEKLAPPRAKLPKWAFEEYLTSPAPTVSGLKSRIIGGNSALPGEIPWQVALVSRSTQQVFCGGSILNPLWVITAAHCLLGNHNGSFYIRVGEHDVSKIEGTEQNVDVIKLISHPRYNSKVSLFNHDIALLRLRSPIRLTPTVRPICLGPMVFSNTLLQSGTLATVSGWGRVRFQGRSAATLQKIELPYVDRTVCKESSSDPITHFMFCAGHSDSPKDACQGDSGGPHVMRYHNTWFLTGIISWGEECAKKGKYGVYTQVGNYYRWIQHTMGVTTGALLTNVDQ

SEQ ID NO: 18 - protein, 537 aa, Takifugu rubripes
  Japanese pufferfish Factor IX
MARDFLLALIAALLLEVSGLPTEGSTGGVFVSPQAANMVLLRQRRYNSGHLEELQKDNLERECKEEQCTMEEAREVFEDDEKTAEFWVGYIDGDQCVPPPCQNEGVCKDGINSYVCWCKPDFSGRNCEIEVSKQCSVNNGGCSHFCVMQGDISVCHCAVGHRLGLDKKSCEPTDQFSCGHINMSFSSKSNVQRRSLMQKLEANRTFSSILLGDYSDNSTELYDYIESMDWAPPNTTMIDPRSGRTSSVGPDQNRSSLTEDLISVSETEIPYWAFPTLPTIPEKENTDQRIVGGDEALPGEIPWQVTLMSHSVILQRAEPFCGGSLFSDLWVITAAHCLINEKIAKQGILHSSREHDVSKDEGPERDHTVAEQHIHFMYDYKKSPYNHDIALLKLNKPVELSNKRRPICLGPKDFTETLLRESTSSLVSGWGRIKFFGLEATKLQKLEVPYVDRTRCKQSSREQVTRYMFCAGYQLQAKDSCQGDSGGPHATKYKDTWFLTGIVSWGEECAKDGKYGIYTRVSRYYPWISQKTGLQMS

SEQ ID NO: 19 - protein, 245 aa, Bos taurus
  Mature chymotrypsin
CGVPAIQPVLSGLSRIVNGEEAVPGSWPWQVSLQDKTGFHFCGGSLINENWVVTAAHCGVTTSDVVVAGEFDQGSSSEKIQKLKIAKVFKNSKYNSLTINNDITLLKLSTAASFSQTVSAVCLPSASDDFAAGTTCVTTGWGLTRYTNANTPDRLQQASLPLLSNTNCKKYWGTKIKDAMICAGASGVSSCMGDSGGPLVCKKNGAWTLVGIVSWGSSTCSTSTPGVYARVTALVNWVQQTLAAN

SEQ ID NO: 20 - protein, 415 aa, Homo sapiens
  BeneFIX, recombinant Factor IX
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAEAVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 21 - protein, 464 aa, Homo sapiens
  Antithrombin III
MYSNVIGTVTSGKRKVYLLSLLLIGFWDCVTCHGSPVDICTAKPRDIPMNPMCIYRSPEKKATEDEGSEQKIPEATNRRVWELSKANSRFATTFYQHLADSKNDNDNIFLSPLSISTAFAMTKLGACNDTLQQLMEVFKFDTISEKTSDQIHFFFAKLNCRLYRKANKSSKLVSANRLFGDKSLTFNETYQDISELVYGAKLQPLDFKENAEQSRAAINKWVSNKTEGRITDVIPSEAINELTVLVLVNTIYFKGLWKSKFSPENTRKELFYKADGESCSASMMYQEGKFRYRRVAEGTQVLELPFKGDDITMVLILPKPEKSLAKVEKELTPEVLQEWLDELEEMMLVVHMPRFRIEDGFSLKEQLQDMGLVDLFSPEKSKLPGIVAEGRDDLYVSDAFHKAFLEVNEEGSEAAASTAVVIAGRSLNPNRVTFKANRPFLVFIREVPLNTIIFMGRVANPCVK

SEQ ID NO: 22 - protein, 432 aa, Homo sapiens [sequence omitted]

SEQ ID NO: 23 - DNA, 4194 bp, Artificial Sequence
  pFUSE-hIgG1-Fc2 vector
ggatctgcgatcgctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagctgaagcttcgaggggctcgcatctctccttcacgcgcccgccgccctacctgaggccgccatccacgccggttgagtcgcgttctgccgcctcccgcctgtggtgcctcctgaactgcgtccgccgtctaggtaagtttaaagctcaggtcgagaccgggcctttgtccggcgctcccttggagcctacctagactcagccggctctccacgctttgcctgaccctgcttgctcaactctacgtctttgtttcgttttctgttctgcgccgttacagatccaagctgtgaccggcgcctacctgagatcaccggcgaaggagggccaccatgtacaggatgcaactcctgtcttgcattgcactaagtcttgcacttgtcacgaattcgatatcggccatggttagatctgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcacgaggctctgcacaaccactacacgcagaagagcctctccctgtctccgggtaaatgagtgctagctggccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggaattaattctaaaatacagcatagcaaaactttaacctccaaatcaagcctctacttgaatccttttctgagggatgaataaggcataggcatcaggggctgttgccaatgtgcattagctgtttgcagcctcaccttctttcatggagtttaagatatagtgtattttcccaaggtttgaactagctcttcatttctttatgttttaaatgcactgacctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagcttctagcttatcctcagtcctgctcctctgccacaaagtgcacgcagttgccggccgggtcgcgcagggcgaactcccgcccccacggctgctcgccgatctcggtcatggccggcccggaggcgtcccggaagttcgtggacacgacctccgaccactcggcgtacagctcgtccaggccgcgcacccacacccaggccagggtgttgtccggcaccacctggtcctggaccgcgctgatgaacagggtcacgtcgtcccggaccacaccggcgaagtcgtcctccacgaagtcccgggagaacccgagccggtcggtccagaactcgaccgctccggcgacgtcgcgcgcggtgagcaccggaacggcactggtcaacttggccatgatggctcctcctgtcaggagaggaaagagaagaaggttagtacaattgctatagtgagttgtattatactatgcagatatactatgccaatgattaattgtcaaactagggctgcagggttcatagtgccacttttcctgcactgccccatctcctgcccaccctttcccaggcatagacagtcagtgacttaccaaactcacaggagggagaaggcagaagcttgagacagacccgcgggaccgccgaactgcgaggggacgtggctagggcggcttcttttatggtgcgccggccctcggaggcagggcgctcggggaggcctagcggccaatctgcggtggcaggaggcggggccgaaggccgtgcctgaccaatccggagcacataggagtctcagccccccgccccaaagcaaggggaagtcacgcgcctgtagcgccagcgtgttgtgaaatgggggcttgggggggttggggccctgactagtcaaaacaaactcccattgacgtcaatggggtggagacttggaaatccccgtgagtcaaaccgctatccacgcccattgatgtactgccaaaaccgcatcatcatggtaatagcgatgactaatacgtagatgtactgccaagtaggaaagtcccataaggtcatgtactgggcataatgccaggcgggccatttaccgtcattgacgtcaatagggggcgtacttggcatatgatacacttgatgtactgccaagtgggcagtttaccgtaaatactccacccattgacgtcaatggaaagtccctattggcgttactatgggaacatacgtcattattgacgtcaatgggcgggggtcgttgggcggtcagccaggcgggccatttaccgtaagttatgtaacgcctgcaggttaattaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatggctagttaattaacatttaaatcagcggccgcaataaaatatctttattttcattacatctgtgtgttggttttttgtgtgaatcgtaactaacatacgctctccatcaaaacaaaacgaaacaaaacaaactagcaaaataggctgtccccagtgcaagtgcaggtgccagaacatttctctatcgaa

SEQ ID NO: 24 - DNA, 25 bp, Artificial Sequence
  pFUSE-Acc-F1 forward primer
gtgctagctggccagacatgataag

SEQ ID NO: 25 - DNA, 27 bp, Artificial Sequence
  pFUSE-Acc-R3 reverse primer
catggtggccctccttcgccggtgatc

SEQ ID NO: 26 - DNA, 36 bp, Artificial Sequence
  Factor IX-wtsp-Invivo-F1 forward primer
cgaaggagggccaccatgcagcgcgtgaacatgatc

SEQ ID NO: 27 - DNA, 40 bp, Artificial Sequence
  Factor IX-Invivo-R1 reverse primer
tgtctggccagctagcacttaagtgagctttgttttttcc

SEQ ID NO: 28 - DNA, 31 bp, Artificial Sequence
  F9-A[103]N/N[105]S-For
gtaaaaatagtaatgatagcaaggtggtttg

SEQ ID NO: 29 - DNA, 42 bp, Artificial Sequence
  F9-D[104]N/K[106]S-For
gtaaaaatagtgctaataacagtgtggtttgctcctgtactg

SEQ ID NO: 30 - DNA, 33 bp, Artificial Sequence
  F9-K[106]N/V[108]S-For
gtgctgataacaatgtgagttgctcctgtactg

SEQ ID NO: 31 - DNA, 28 bp, Artificial Sequence
  F9-D[85]N-For
gaactgtgaattaaatgtaacatgtaac

SEQ ID NO: 32 - DNA, 33 bp, Artificial Sequence
  F9-T[148]A-For
ctcacccgtgctgaggctgtttttcctgatgtg

SEQ ID NO: 33 - DNA, 37 bp, Artificial Sequence
  F9-D39N/F41T-For
gaatggtaaagttaatgcaacctgtggaggctctatc

SEQ ID NO: 34 - DNA, 29 bp, Artificial Sequence
  F9-K63N-For
gaaactggtgttaacattacagttgtcgc

SEQ ID NO: 35 - DNA, 26 bp, Artificial Sequence
  F9-I86S-For
gcgaaatgtgagtcgaattattcctc

SEQ ID NO: 36 - DNA, 31 bp, Artificial Sequence
  F9-A95bS-For
caactacaatgcaagtattaataagtacaac

SEQ ID NO: 37 - DNA, 34 bp, Artificial Sequence
  F9-K243N-For
aaggaaaaaacaaatctcacttaagtgctagctg

SEQ ID NO: 38 - DNA, 25 bp, Artificial Sequence
  F9-E240N-For
ctggattaagaataaaacaaagctc

SEQ ID NO: 39 - DNA, 36 bp, Artificial Sequence
  F9-E74N-For
caggtgaacataatattaacgagacagaacatacag

SEQ ID NO: 40 - DNA, 39 bp, Artificial Sequence
  F9-T76N/H78S-For
gaacataatattgaggagaacgaaagtacagagcaaaag

SEQ ID NO: 41 - DNA, 42 bp, Artificial Sequence
  F9-K82N/N84S-For
cagaacatacagagcaaaatcgatctgtgattcgaattattc

SEQ ID NO: 42 - DNA, 27 bp, Artificial Sequence
  F9-L153N-For
gggagatcagctaatgttcttcagtac

SEQ ID NO: 43 - DNA, 32 bp, Artificial Sequence
  F9-F145N/H147S-For
ctggggaagagtcaactccaaagggagatcag

SEQ ID NO: 44 - DNA, 35 bp, Artificial Sequence
  F9-K222N/K224S-For
gagtgtgcaatgaacggctcatatggaatatatac

SEQ ID NO: 45 - DNA, 33 bp, Artificial Sequence
  F9-S151N/L153S-For
cttccacaaagggagaaatgcttcagttcttca

SEQ ID NO: 46 - DNA, 40 bp, Artificial Sequence
  F9-N95S-For
cctcaccacaactacagtgcagctattaataagtacaacc

SEQ ID NO: 47 - DNA, 34 bp, Artificial Sequence
  F9-Y117N-For
cttagtgctaaacagcaacgttacacctatttgc

SEQ ID NO: 48 - DNA, 37 bp, Artificial Sequence
  F9-G149N-For
ggaagagtcttccacaaaaacagatcagctttagttc

SEQ ID NO: 49 - DNA, 39 bp, Artificial Sequence
  F9-R150N/A152S-For
gtcttccacaaagggaactcatctttagttcttcagtac

SEQ ID NO: 50 - DNA, 36 bp, Artificial Sequence
  F9-R150A-For
gtcttccacaaaggggcatcagctttagttcttcag

SEQ ID NO: 51 - DNA, 36 bp, Artificial Sequence
  F9-R150E-For
gtcttccacaaaggggaatcagctttagttcttcag

SEQ ID NO: 52 - DNA, 36 bp, Artificial Sequence
  F9-R150Y-For
gtcttccacaaagggtactcagctttagttcttcag

SEQ ID NO: 53 - DNA, 33 bp, Artificial Sequence
  F9-R143Q-For
gtaagtggctggggacaagtcttccacaaaggg

SEQ ID NO: 54 - DNA, 33 bp, Artificial Sequence
  F9-R143A-For
gtaagtggctggggagcagtcttccacaaaggg

SEQ ID NO: 55 - DNA, 33 bp, Artificial Sequence
  F9-R143Y-For
gtaagtggctggggatacgtcttccacaaaggg

SEQ ID NO: 56 - DNA, 33 bp, Artificial Sequence
  F9-R143L-For
gtaagtggctggggactggtcttccacaaaggg

SEQ ID NO: 57 - DNA, 36 bp, Artificial Sequence
  F9-V38M-For
gttttgaatggtaaaatggatgcattctgtggaggc

SEQ ID NO: 58 - DNA, 36 bp, Artificial Sequence
  F9-V38Y-For
gttttgaatggtaaatacgatgcattctgtggaggc

SEQ ID NO: 59 - DNA, 36 bp, Artificial Sequence
  F9-D39M-For
gttttgaatggtaaagttatggcattctgtggaggc

SEQ ID NO: 60 - DNA, 36 bp, Artificial Sequence
  F9-D39Y-For
gttttgaatggtaaagtttacgcattctgtggaggc

SEQ ID NO: 61 - DNA, 42 bp, Artificial Sequence
  F9-A40M-For
gttttgaatggtaaagttgatatgttctgtggaggctctatc

SEQ ID NO: 62 - DNA, 42 bp, Artificial Sequence
  F9-A40Y-For
gttttgaatggtaaagttgattacttctgtggaggctctatc

SEQ ID NO: 63 - DNA, 49 bp, Artificial Sequence
  F9-R233A/K230A-For
caaatatggaatatataccgcagtatccgcatatgtcaactggattaag

SEQ ID NO: 64 - DNA, 49 bp, Artificial Sequence
  F9-R233E/K230E-For
caaatatggaatatataccgaagtatccgaatatgtcaactggattaag

SEQ ID NO: 65 - DNA, 41 bp, Artificial Sequence
  F9-R233A-For
gaatatataccaaggtatccgcatatgtcaactggattaag

SEQ ID NO: 66 - DNA, 41 bp, Artificial Sequence
  F9-R233E-For
gaatatataccaaggtatccgaatatgtcaactggattaag

SEQ ID NO: 67 - DNA, 37 bp, Artificial Sequence
  F9-K230A-For
caaatatggaatatataccgcagtatcccggtatgtc

SEQ ID NO: 68 - DNA, 37 bp, Artificial Sequence
  F9-K230E-For
caaatatggaatatataccgaagtatcccggtatgtc

SEQ ID NO: 69 - DNA, 36 bp, Artificial Sequence
  F9-K126E-For
cctatttgcattgctgacgaagaatacacgaacatc

SEQ ID NO: 70 - DNA, 36 bp, Artificial Sequence
  F9-K126A-For
cctatttgcattgctgacgcagaatacacgaacatc

SEQ ID NO: 71 - DNA, 36 bp, Artificial Sequence
  F9-R165A-For
gttccacttgttgacgcagccacatgtcttcgatct

SEQ ID NO: 72 - DNA, 36 bp, Artificial Sequence
  F9-R165E-For
gttccacttgttgacgaagccacatgtcttcgatct

SEQ ID NO: 73 - DNA, 33 bp, Artificial Sequence
  F9-R170A-For
cgagccacatgtcttgcatctacaaagttcacc

SEQ ID NO: 74 - DNA, 33 bp, Artificial Sequence
  F9-R170E-For
cgagccacatgtcttgaatctacaaagttcacc

SEQ ID NO: 75 - protein, 415 aa, Homo sapiens
  Factor IX N157D
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVDSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 76 - protein, 415 aa, Homo sapiens
  Factor IX Y155F
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDFVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 77 - protein, 415 aa, Homo sapiens
  Factor IX A103N/N105S
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSNDSKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 78 - protein, 415 aa, Homo sapiens
  Factor IX D104N/K106S
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSANNSVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 79 - protein, 415 aa, Homo sapiens
  Factor IX K106N/V108S
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNNVSCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 80 - protein, 415 aa, Homo sapiens
  Factor IX D85N
YNSGKLEEFVQGNLERECMEEKCSFEEAREVFENTERTTEFWKQYVDGDQCESNPCLNGGSCKDDINSYECWCPFGFEGKNCELNVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 81 - protein, 415 aa, Homo sapiens; identical to SEQ ID NO: 20
  Factor IX T148A

SEQ ID NO: 82 - protein, 415 aa, Homo sapiens
  Factor IX K5A
YNSGALEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 83 - protein, 415 aa, Homo sapiens
  Factor IX D64N
YNSGKLEEFVQGNLERECMEEKCSFEEAREVFENTERTTEFWKQYVDGDQCESNPCLNGGSCKNDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 84 - protein, 415 aa, Homo sapiens
  Factor IX D64A
YNSGKLEEFVQGNLERECMEEKCSFEEAREVFENTERTTEFWKQYVDGDQCESNPCLNGGSCKADINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 85 - protein, 415 aa, Homo sapiens
  Factor IX N167D
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDDITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 86 - protein, 415 aa, Homo sapiens
  Factor IX N167Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDQITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 87 - protein, 415 aa, Homo sapiens
  Factor IX S61A
YNSGKLEEFVQGNLERECMEEKCSFEEAREVFENTERTTEFWKQYVDGDQCESNPCLNGGACKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 88 - protein, 415 aa, Homo sapiens
  Factor IX S53A
YNSGKLEEFVQGNLERECMEEKCSFEEAREVFENTERTTEFWKQYVDGDQCEANPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 89 - protein, 415 aa, Homo sapiens
  Factor IX T159A
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSAEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 90 - protein, 415 aa, Homo sapiens
  Factor IX T169A
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNIAQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 91 - protein, 415 aa, Homo sapiens
  Factor IX T172A
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSAQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 92 - protein, 415 aa, Homo sapiens
  Factor IX T179A
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFARVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 93 - protein, 415 aa, Homo sapiens
  Factor IX Y155H
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDHVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 94 - protein, 415 aa, Homo sapiens
  Factor IX Y155Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDQVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 95 - protein, 415 aa, Homo sapiens
  Factor IX S158A
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNATEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 96 - protein, 415 aa, Homo sapiens
  Factor IX S158D
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNDTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 97 - protein, 415 aa, Homo sapiens
  Factor IX S158E
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNETEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 98 - protein, 415 aa, Homo sapiens
  Factor IX N157Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVQSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 99 - protein, 415 aa, Homo sapiens
  Factor IX D203N/F205T
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVNATCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 100 - protein, 415 aa, Homo sapiens
  Factor IX D85N/D203N/F205T
YNSGKLEEFVQGNLERECMEEKCSFEEAREVFENTERTTEFWKQYVDGDQCESNPCLNGGSCKDDINSYECWCPFGFEGKNCELNVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVNATCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 101 - protein, 415 aa, Homo sapiens
  Factor IX K228N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVNITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 102 - protein, 415 aa, Homo sapiens
  Factor IX D85N/K228N
YNSGKLEEFVQGNLERECMEEKCSFEEAREVFENTERTTEFWKQYVDGDQCESNPCLNGGSCKDDINSYECWCPFGFEGKNCELNVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVNITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 103 - protein, 415 aa, Homo sapiens
  Factor IX I251S
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVSRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 104 - protein, 415 aa, Homo sapiens
  Factor IX D85N/I251S
YNSGKLEEFVQGNLERECMEEKCSFEEAREVFENTERTTEFWKQYVDGDQCESNPCLNGGSCKDDINSYECWCPFGFEGKNCELNVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVSRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 105 - protein, 415 aa, Homo sapiens
  Factor IX D85N/D104N/K106S/I251S
YNSGKLEEFVQGNLERECMEEKCSFEEAREVFENTERTTEFWKQYVDGDQCESNPCLNGGSCKDDINSYECWCPFGFEGKNCELNVTCNIKNGRCEQFCKNSANNSVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVSRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 106 - protein, 415 aa, Homo sapiens
  Factor IX A262S
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNASINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 107 - protein, 415 aa, Homo sapiens
  Factor IX K413N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTNLT

SEQ ID NO: 108 - protein, 415 aa, Homo sapiens
  Factor IX E410N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKNKTKLT

SEQ ID NO: 109 - protein, 415 aa, Homo sapiens
  Factor IX E239N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNINETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 110 - protein, 415 aa, Homo sapiens
  Factor IX T241N/H243S
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEENESTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 111 - protein, 415 aa, Homo sapiens
  Factor IX K247N/N249S
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQNRSVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 112 - protein, 415 aa, Homo sapiens
  Factor IX L321N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSANVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 113 - protein, 415 aa, Homo sapiens
  Factor IX F314N/H315S
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVNSKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 114 - protein, 415 aa, Homo sapiens
  Factor IX K392N/K394S
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMNGSYGIYTKVSRYVNWIKEKTKLT

SEQ ID NO: 115 - protein, 415 aa, Homo sapiens
  Factor IX S319N/L321S
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRNASVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 116 - protein, 415 aa, Homo sapiens
  Factor IX N260S
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYSAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 117 - protein, 415 aa, Homo sapiens
  Factor IX Y284N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSNVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 118 - protein, 415 aa, Homo sapiens
  Factor IX G317N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKNRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 119 - protein, 415 aa, Homo sapiens
  Factor IX R318N/A320S
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGNSSLVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 120 - protein, 415 aa, Homo sapiens
  Factor IX R318A
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGASALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 121 - protein, 415 aa, Homo sapiens
  Factor IX R318E
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGESALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 122 - protein, 415 aa, Homo sapiens
  Factor IX R318Y
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGYSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 123 - protein, 415 aa, Homo sapiens
  Factor IX R312Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGQVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 124 - protein, 415 aa, Homo sapiens
  Factor IX R312A
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGAVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 125 - protein, 415 aa, Homo sapiens
  Factor IX R312Y
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGYVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 126 - protein, 415 aa, Homo sapiens
  Factor IX R312L
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGLVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 127 - protein, 415 aa, Homo sapiens
  Factor IX V202M
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKMDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 128 - protein, 415 aa, Homo sapiens
  Factor IX V202Y
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKYDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 129 - protein, 415 aa, Homo sapiens
  Factor IX D203M
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVMAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 130 - protein, 415 aa, Homo sapiens
  Factor IX D203Y
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVYAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 131 - protein, 415 aa, Homo sapiens
  Factor IX A204M
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDMFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 132 - protein, 415 aa, Homo sapiens
  Factor IX A204Y
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDYFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 133 - protein, 415 aa, Homo sapiens
  Factor IX K400A/R403A
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTAVSAYVNWIKEKTKLT

SEQ ID NO: 134 - protein, 415 aa, Homo sapiens
  Factor IX K400E/R403E
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTEVSEYVNWIKEKTKLT

SEQ ID NO: 135 - protein, 415 aa, Homo sapiens
  Factor IX R403A
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSAYVNWIKEKTKLT

SEQ ID NO: 136 - protein, 415 aa, Homo sapiens
  Factor IX R403E
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSEYVNWIKEKTKLT

SEQ ID NO: 137 - protein, 415 aa, Homo sapiens
  Factor IX K400A
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTAVSRYVNWIKEKTKLT

SEQ ID NO: 138 - protein, 415 aa, Homo sapiens
  Factor IX K400E
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTEVSRYVNWIKEKTKLT

SEQ ID NO: 139 - protein, 415 aa, Homo sapiens
  Factor IX K293E
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADEEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 140 - protein, 415 aa, Homo sapiens
  Factor IX K293A
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADAEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 141 - protein, 415 aa, Homo sapiens
  Factor IX R333A
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDAATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 142 - protein, 415 aa, Homo sapiens
  Factor IX R333E
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDEATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 143 - protein, 415 aa, Homo sapiens
  Factor IX R338A
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLASTKFTIYNNMFCAGFHEGGRDSCQGDSGGPHVTEVEGTSFLTGIISWGEECAMKGKYGIYTKVSRYVNWIKEKTKLT

SEQ ID NO: 144 - protein, 415 aa, Homo sapiens
  Factor IX R338E
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLESTKFTIYNNMFCAGFHEGGRDSCQGDSGGPHVTEVEGTSFLTGIISWGEECAMKGKYGIYTKVSRYVNWIKEKTKLT

SEQ ID NO: 145 - protein, 415 aa, Homo sapiens
  Factor IX R338A/R403A
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLASTKFTIYNNMFCAGFHEGGRDSCQGDSGGPHVTEVEGTSFLTGIISWGEECAMKGKYGIYTKVSAYVNWIKEKTKLT

SEQ ID NO: 146 - protein, 415 aa, Homo sapiens
  Factor IX R338E/R403E
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLESTKFTIYNNMFCAGFHEGGRDSCQGDSGGPHVTEVEGTSFLTGIISWGEECAMKGKYGIYTKVSEYVNWIKEKTKLT

SEQ ID NO: 147 - protein, 415 aa, Homo sapiens
  Factor IX K293A/R403A
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADAEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSAYVNWIKEKTKLT

SEQ ID NO: 148 - protein, 415 aa, Homo sapiens
  Factor IX K293E/R403E
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADEEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSEYVNWIKEKTKLT

SEQ ID NO: 149 - protein, 415 aa, Homo sapiens
  Factor IX K293A/R338A/R403A
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADAEYTNIFLKFGSGYVSGWGRVFHKGRSALVLQYLRVPLVDRATCLASTKFTIYNNMFCAGFHEGGRDSCQGDSGGPHVTEVEGTSFLTGIISWGEECAMKGKYGIYTKVSAYVNWIKEKTKLT

SEQ ID NO: 150 - protein, 415 aa, Homo sapiens
  Factor IX K293E/R338E/R403E
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADEEYTNIFLKFGSGYVSGWGRVFHKGRSALVLQYLRVPLVDRATCLESTKFTIYNNMFCAGFHEGGRDSCQGDSGGPHVTEVEGTSFLTGIISWGEECAMKGKYGIYTKVSEYVNWIKEKTKLT

SEQ ID NO: 151 - protein, 415 aa, Homo sapiens
  Factor IX R318A/R403A
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGASALVLQYLRVPLVDRATCLRSTKFTIYNNMFCAGFHEGGRDSCQGDSGGPHVTEVEGTSFLTGIISWGEECAMKGKYGIYTKVSAYVNWIKEKTKLT

SEQ ID NO: 152 - protein, 415 aa, Homo sapiens
  Factor IX R318E/R403E
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGESALVLQYLRVPLVDRATCLRSTKFTIYNNMFCAGFHEGGRDSCQGDSGGPHVTEVEGTSFLTGIISWGEECAMKGKYGIYTKVSEYVNWIKEKTKLT

SEQ ID NO: 153 - protein, 415 aa, Homo sapiens
  Factor IX R318Y/E410N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGYSALVLQYLRVPLVDRATCLRSTKFTIYNNMFCAGFHEGGRDSCQGDSGGPHVTEVEGTSFLTGIISWGEECAMKGKYGIYTKVSRYVNWIKNKTKLT

SEQ ID NO: 154 - protein, 415 aa, Homo sapiens
  Factor IX R338E/E410N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLESTKFTIYNNMFCAGFHEGGRDSCQGDSGGPHVTEVEGTSFLTGIISWGEECAMKGKYGIYTKVSRYVNWIKNKTKLT

SEQ ID NO: 155 - protein, 415 aa, Homo sapiens
  Factor IX R338E/R403E/E410N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLESTKFTIYNNMFCAGFHEGGRDSCQGDSGGPHVTEVEGTSFLTGIISWGEECAMKGKYGIYTKVSEYVNWIKNKTKLT

SEQ ID NO: 156 - protein, 415 aa, Homo sapiens
  Factor IX R318Y/R338E/R403E
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGYSALVLQYLRVPLVDRATCLESTKFTIYNNMFCAGFHEGGRDSCQGDSGGPHVTEVEGTSFLTGIISWGEECAMKGKYGIYTKVSEYVNWIKEKTKLT

SEQ ID NO: 157 - protein, 415 aa, Homo sapiens
  Factor IX D203N/F205T/K228N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVNATCGGSIVNEKWIVTAAHCVETGVNITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 158 - protein, 415 aa, Homo sapiens
  Factor IX D203N/F205T/E410N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVNATCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKNKTKLT

SEQ ID NO: 159 - protein, 415 aa, Homo sapiens
  Factor IX D203N/F205T/R338E
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVNATCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLESTKFTIYNNMFCAGFHEGGRDSCQGDSGGPHVTEVEGTSFLTGIISWGEECAMKGKYGIYTKVSRYVNWIKEKTKLT

SEQ ID NO: 160 - protein, 415 aa, Homo sapiens
  Factor IX D203N/F205T/R338A
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVNATCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLASTKFTIYNNMFCAGFHEGGRDSCQGDSGGPHVTEVEGTSFLTGIISWGEECAMKGKYGIYTKVSRYVNWIKEKTKLT

SEQ ID NO: 161 - protein, 415 aa, Homo sapiens
  Factor IX D203N/F205T/R318Y
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVNATCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGYSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 162 - protein, 415 aa, Homo sapiens
  Factor IX D203N/F205T/R338E/R403E
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVNATCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLESTKFTIYNNMFCAGFHEGGRDSCQGDSGGPHVTEVEGTSFLTGIISWGEECAMKGKYGIYTKVSEYVNWIKEKTKLT

SEQ ID NO: 163 - protein, 415 aa, Homo sapiens
  Factor IX K228N/E410N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVNITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKNKTKLT

SEQ ID NO: 164 - protein, 415 aa, Homo sapiens
  Factor IX K228N/R338E
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVNITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLESTKFTIYNNMFCAGFHEGGRDSCQGDSGGPHVTEVEGTSFLTGIISWGEECAMKGKYGIYTKVSRYVNWIKEKTKLT

SEQ ID NO: 165 - protein, 415 aa, Homo sapiens
  Factor IX K228N/R338A
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVNITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLASTKFTIYNNMFCAGFHEGGRDSCQGDSGGPHVTEVEGTSFLTGIISWGEECAMKGKYGIYTKVSRYVNWIKEKTKLT

SEQ ID NO: 166 - protein, 415 aa, Homo sapiens
  Factor IX K228N/R318Y
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVNITVVAGEHNIEETEHTEQKRNVIRIIPHHNYNAAINKYNHDIALLELDEPLVLNSYVTPICIADKEYTNIFLKFGSGYVSGWGRVFHKGYSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 167 - protein, 415 aa, Homo sapiens
  Factor IX K228N/R338E/R403E
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVNITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLESTKFTIYNNMFCAGFHEGGRDSCQGDSGGPHVTEVEGTSFLTGIISWGEECAMKGKYGIYTKVSEYVNWIKEKTKLT

SEQ ID NO: 168 - protein, 415 aa, Homo sapiens
  Factor IX R403E/E410N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSEYVNWIKNKTKLT

SEQ ID NO: 169 - protein, 415 aa, Homo sapiens
  Factor IX R318Y/R338E/E410N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGYSALVLQYLRVPLVDRATCLESTKFTIYNNMFCAGFHEGGRDSCQGDSGGPHVTEVEGTSFLTGIISWGEECAMKGKYGIYTKVSRYVNWIKNKTKLT

SEQ ID NO: 170 - protein, 415 aa, Homo sapiens
  Factor IX K228N/R318Y/E410N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVNITVVAGEHNIEETEHTEQKRNVIRIIPHHNYNAAINKYNHDIALLELDEPLVLNSYVTPICIADKEYTNIFLKFGSGYVSGWGRVFHKGYSALVLQYLRVPLVDRATCLRSTKFTIYNNMFCAGFHEGGRDSCQGDSGGPHVTEVEGTSFLTGIISWGEECAMKGKYGIYTKVSRYVNWIKNKTKLT

SEQ ID NO: 171 - protein, 415 aa, Homo sapiens
  Factor IX R318Y/R403E/E410N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGYSALVLQYLRVPLVDRATCLRSTKFTIYNNMFCAGFHEGGRDSCQGDSGGPHVTEVEGTSFLTGIISWGEECAMKGKYGIYTKVSEYVNWIKNKTKLT

SEQ ID NO: 172 - protein, 415 aa, Homo sapiens
  Factor IX R318Y/R338E/R403E/E410N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGYSALVLQYLRVPLVDRATCLESTKFTIYNNMFCAGFHEGGRDSCQGDSGGPHVTEVEGTSFLTGIISWGEECAMKGKYGIYTKVSEYVNWIKNKTKLT

SEQ ID NO: 173 - protein, 415 aa, Homo sapiens
  Factor IX D203N/F205T/R318Y/E410N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVNATCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGYSALVLQYLRVPLVDRATCLRSTKFTIYNNMFCAGFHEGGRDSCQGDSGGPHVTEVEGTSFLTGIISWGEECAMKGKYGIYTKVSRYVNWIKNKTKLT

SEQ ID NO: 174 - protein, 415 aa, Homo sapiens
  Factor IX E410Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKQKTKLT

SEQ ID NO: 175 - protein, 415 aa, Homo sapiens
  Factor IX E410S
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKSKTKLT

SEQ ID NO: 176 - protein, 415 aa, Homo sapiens
  Factor IX E410A
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKAKTKLT

SEQ ID NO: 177 - protein, 415 aa, Artificial Sequence
  Factor IX F314N/K316S
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVNHSGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 178 - protein, 415 aa, Artificial Sequence
  Factor IX A103N/N105S/K247N/N249S
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSNDSKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQNRSVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 179 - protein, 415 aa, Artificial Sequence
  Factor IX D104N/K106S/K247N/N249S
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSANNSVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQNRSVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 180 - protein, 415 aa, Artificial Sequence
  Factor IX K228N/I251S
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVNITVVAGEHNIEETEHTEQKRNVSRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 181 - protein, 415 aa, Artificial Sequence
  Factor IX A103N/N105S/I251S
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSNDSKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVSRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 182 - protein, 415 aa, Artificial Sequence
  Factor IX D104N/K106S/I251S
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSANNSVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVSRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 183 - protein, 415 aa, Artificial Sequence
  Factor IX K228N/K247N/N249S
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVNITVVAGEHNIEETEHTEQNRSVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 184 - protein, 415 aa, Artificial Sequence
  Factor IX D104N/K106S/K228N/K247N/N249S
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSANNSVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVNITVVAGEHNIEETEHTEQNRSVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 185 - protein, 415 aa, Artificial Sequence
  Factor IX D104N/K106S/N260S
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSANNSVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYSAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 186 - protein, 415 aa, Artificial Sequence
  Factor IX R333S
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDSATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 187 - protein, 415 aa, Artificial Sequence
  Factor IX R333L
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDLATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 188 - protein, 415 aa, Artificial Sequence
  Factor IX R318Y/R338E
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGYSALVLQYLRVPLVDRATCLESTKFTIYNNMFCAGFHEGGRDSCQGDSGGPHVTEVEGTSFLTGIISWGEECAMKGKYGIYTKVSRYVNWIKEKTKLT

SEQ ID NO: 189 - protein, 415 aa, Artificial Sequence
  Factor IX K316N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHNGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 190 - protein, 415 aa, Artificial Sequence
  Factor IX K316A
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHAGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 191 - protein, 415 aa, Artificial Sequence
  Factor IX K316E
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHEGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 192 - protein, 415 aa, Artificial Sequence
  Factor IX K316S
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHSGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 193 - protein, 415 aa, Artificial Sequence
  Factor IX K316M
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHMGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 194 - protein, 415 aa, Artificial Sequence
  Factor IX E239S
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNISETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 195 - protein, 415 aa, Artificial Sequence
  Factor IX E239A
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIAETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 196 - protein, 415 aa, Artificial Sequence
  Factor IX E239R
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIRETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 197 - protein, 415 aa, Artificial Sequence
  Factor IX E239K
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIKETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 198 - protein, 415 aa, Artificial Sequence
  Factor IX H257F
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHFNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 199 - protein, 415 aa, Artificial Sequence
  Factor IX H257Y
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHYNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 200 - protein, 415 aa, Artificial Sequence
  Factor IX H257E
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHENYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 201 - protein, 415 aa, Artificial Sequence
  Factor IX H257S
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHSNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 202 - protein, 415 aa, Artificial Sequence
  Factor IX T412A
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKAKLT

SEQ ID NO: 203 - protein, 415 aa, Artificial Sequence
  Factor IX T412V
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKVKLT

SEQ ID NO: 204 - protein, 415 aa, Artificial Sequence
  Factor IX E410N/T412A
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKNKAKLT

SEQ ID NO: 205 - protein, 415 aa, Artificial Sequence
  Factor IX E410N/T412V
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKNKVKLT

SEQ ID NO: 206 - protein, 415 aa, Artificial Sequence
  Factor IX E410D
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKDKTKLT

SEQ ID NO: 207 - protein, 415 aa, Artificial Sequence
  Factor IX N346D
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYDNMFCAGFHEGGRDSCQGDSGGPHVTEVEGTSFLTGIISWGEECAMKGKYGIYTKVSRYVNWIKEKTKLT

SEQ ID NO: 208 - protein, 415 aa, Artificial Sequence
  Factor IX N346Y
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYYNMFCAGFHEGGRDSCQGDSGGPHVTEVEGTSFLTGIISWGEECAMKGKYGIYTKVSRYVNWIKEKTKLT

SEQ ID NO: 209 - protein, 415 aa, Artificial Sequence
  Factor IX T343R
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFRIYNNMFCAGFHEGGRDSCQGDSGGPHVTEVEGTSFLTGIISWGEECAMKGKYGIYTKVSRYVNWIKEKTKLT

SEQ ID NO: 210 - protein, 415 aa, Artificial Sequence
  Factor IX T343E
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFEIYNNMFCAGFHEGGRDSCQGDSGGPHVTEVEGTSFLTGIISWGEECAMKGKYGIYTKVSRYVNWIKEKTKLT

SEQ ID NO: 211 - protein, 415 aa, Artificial Sequence
  Factor IX T343Q
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFQIYNNMFCAGFHEGGRDSCQGDSGGPHVTEVEGTSFLTGIISWGEECAMKGKYGIYTKVSRYVNWIKEKTKLT

SEQ ID NO: 212 - protein, 415 aa, Artificial Sequence
  Factor IX F342I
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKITIYNNMFCAGFHEGGRDSCQGDSGGPHVTEVEGTSFLTGIISWGEECAMKGKYGIYTKVSRYVNWIKEKTKLT

SEQ ID NO: 213 - protein, 415 aa, Artificial Sequence
  Factor IX Y345A
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIANNMFCAGFHEGGRDSCQGDSGGPHVTEVEGTSFLTGIISWGEECAMKGKYGIYTKVSRYVNWIKEKTKLT

SEQ ID NO: 214 - protein, 415 aa, Artificial Sequence
  Factor IX Y345T
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTITNNMFCAGFHEGGRDSCQGDSGGPHVTEVEGTSFLTGIISWGEECAMKGKYGIYTKVSRYVNWIKEKTKLT

SEQ ID NO: 215 - protein, 415 aa, Artificial Sequence
  Factor IX T343R/Y345T
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFRITNNMFCAGFHEGGRDSCQGDSGGPHVTEVEGTSFLTGIISWGEECAMKGKYGIYTKVSRYVNWIKEKTKLT

SEQ ID NO: 216 - protein, 415 aa, Artificial Sequence
  Factor IX Y259F/K265T/Y345T
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNFNAAINTYNHDIALLELDEPLVLNSYVTPICIADKEYTNIFLKFGSGYVSGWGRVFHKGRSALVLQYLRVPLVDRATCLRSTKFTITNNMFCAGFHEGGRDSCQGDSGGPHVTEVEGTSFLTGIISWGEECAMKGKYGIYTKVSRYVNWIKEKTKLT

SEQ ID NO: 217 - protein, 415 aa, Artificial Sequence
  Factor IX A103N/N105S/K228N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSNDSKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVNITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 218 - protein, 415 aa, Artificial Sequence
  Factor IX D104N/K106S/K228N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSANNSVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVNITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 219 - protein, 415 aa, Artificial Sequence
  Factor IX A103N/N105S/R318Y/R338E/R403E/E410N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSNDSKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGYSALVLQYLRVPLVDRATCLESTKFTIYNNMFCAGFHEGGRDSCQGDSGGPHVTEVEGTSFLTGIISWGEECAMKGKYGIYTKVSEYVNWIKNKTKLT

SEQ ID NO: 220 - protein, 415 aa, Artificial Sequence
  Factor IX D104N/K106S/R318Y/R338E/R403E/E410N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSANNSVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGYSALVLQYLRVPLVDRATCLESTKFTIYNNMFCAGFHEGGRDSCQGDSGGPHVTEVEGTSFLTGIISWGEECAMKGKYGIYTKVSEYVNWIKNKTKLT

SEQ ID NO: 221 - protein, 415 aa, Artificial Sequence
  Factor IX K228N/R318Y/R338E/R403E/E410N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVNITVVAGEHNIEETEHTEQKRNVIRIIPHHNYNAAINKYNHDIALLELDEPLVLNSYVTPICIADKEYTNIFLKFGSGYVSGWGRVFHKGYSALVLQYLRVPLVDRATCLESTKFTIYNNMFCAGFHEGGRDSCQGDSGGPHVTEVEGTSFLTGIISWGEECAMKGKYGIYTKVSEYVNWIKNKTKLT

SEQ ID NO: 222 - protein, 415 aa, Artificial Sequence
  Factor IX I251S/R318Y/R338E/R403E/E410N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVSRIIPHHNYNAAINKYNHDIALLELDEPLVLNSYVTPICIADKEYTNIFLKFGSGYVSGWGRVFHKGYSALVLQYLRVPLVDRATCLESTKFTIYNNMFCAGFHEGGRDSCQGDSGGPHVTEVEGTSFLTGIISWGEECAMKGKYGIYTKVSEYVNWIKNKTKLT

SEQ ID NO: 223 - protein, 415 aa, Artificial Sequence
  Factor IX D104N/K106S/I251S/R318Y/R338E/R403E/E410N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSANNSVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVSRIIPHHNYNAAINKYNHDIALLELDEPLVLNSYVTPICIADKEYTNIFLKFGSGYVSGWGRVFHKGYSALVLQYLRVPLVDRATCLESTKFTIYNNMFCAGFHEGGRDSCQGDSGGPHVTEVEGTSFLTGIISWGEECAMKGKYGIYTKVSEYVNWIKNKTKLT

SEQ ID NO: 224 - protein, 415 aa, Artificial Sequence
  Factor IX D104N/K106S/R318Y/R338E/E410N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSANNSVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGYSALVLQYLRVPLVDRATCLESTKFTIYNNMFCAGFHEGGRDSCQGDSGGPHVTEVEGTSFLTGIISWGEECAMKGKYGIYTKVSRYVNWIKNKTKLT

SEQ ID NO: 225 - protein, 415 aa, Artificial Sequence
  Factor IX I251S/R318Y/R338E/E410N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVSRIIPHHNYNAAINKYNHDIALLELDEPLVLNSYVTPICIADKEYTNIFLKFGSGYVSGWGRVFHKGYSALVLQYLRVPLVDRATCLESTKFTIYNNMFCAGFHEGGRDSCQGDSGGPHVTEVEGTSFLTGIISWGEECAMKGKYGIYTKVSRYVNWIKNKTKLT

SEQ ID NO: 226 - protein, 415 aa, Artificial Sequence
  Factor IX D104N/K106S/I251S/R318Y/R338E/E410N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSANNSVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVSRIIPHHNYNAAINKYNHDIALLELDEPLVLNSYVTPICIADKEYTNIFLKFGSGYVSGWGRVFHKGYSALVLQYLRVPLVDRATCLESTKFTIYNNMFCAGFHEGGRDSCQGDSGGPHVTEVEGTSFLTGIISWGEECAMKGKYGIYTKVSRYVNWIKNKTKLT

SEQ ID NO: 227 - protein, 415 aa, Artificial Sequence
  Factor IX A103N/N105S/Y155F
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSNDSKVVCSCTEGYRLAENQKSCEPAVPFPCGRVSVSQTSKLTRAETVFPDVDFVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 228 - protein, 415 aa, Artificial Sequence
  Factor IX D104N/K106S/Y155F
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSANNSVVCSCTEGYRLAENQKSCEPAVPFPCGRVSVSQTSKLTRAETVFPDVDFVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 229 - protein, 415 aa, Artificial Sequence
  Factor IX Y155F/K228N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDFVNSTEAETILDNITQSTQSFNDFTRVVGGEDAKPGQFPWQVVLNGKVDAFCGGSIVNEKWIVTAAHCVETGVNITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 230 - protein, 415 aa, Artificial Sequence
  Factor IX Y155F/I251S
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDFVNSTEAETILDNITQSTQSFNDFTRVVGGEDAKPGQFPWQVVLNGKVDAFCGGSIVNEKWIVTAAHCVETGVKITVVAGEHNIEETEHTEQKRNVSRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 231 - protein, 415 aa, Artificial Sequence
  Factor IX Y155F/K247N/N249S
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDFVNSTEAETILDNITQSTQSFNDFTRVVGGEDAKPGQFPWQVVLNGKVDAFCGGSIVNEKWIVTAAHCVETGVKITVVAGEHNIEETEHTEQNRSVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 232 - protein, 415 aa, Artificial Sequence
  Factor IX A103N/N105S/K247N/N249S/R318Y/R338E/R403E/E410N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSNDSKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQNRSVIRIIPHHNYNAAINKYNHDIALLELDEPLVLNSYVTPICIADKEYTNIFLKFGSGYVSGWGRVFHKGYSALVLQYLRVPLVDRATCLESTKFTIYNNMFCAGFHEGGRDSCQGDSGGPHVTEVEGTSFLTGIISWGEECAMKGKYGIYTKVSEYVNWIKNKTKLT

SEQ ID NO: 233 - protein, 415 aa, Artificial Sequence
  Factor IX D104N/K106S/K247N/N249S/R318Y/R338E/R403E/E410N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSANNSVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQNRSVIRIIPHHNYNAAINKYNHDIALLELDEPLVLNSYVTPICIADKEYTNIFLKFGSGYVSGWGRVFHKGYSALVLQYLRVPLVDRATCLESTKFTIYNNMFCAGFHEGGRDSCQGDSGGPHVTEVEGTSFLTGIISWGEECAMKGKYGIYTKVSEYVNWIKNKTKLT

SEQ ID NO: 234 - protein, 415 aa, Artificial Sequence
  Factor IX K228N/K247N/N249S/R318Y/R338E/R403E/E410N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVNITVVAGEHNIEETEHTEQNRSVIRIIPHHNYNAAINKYNHDIALLELDEPLVLNSYVTPICIADKEYTNIFLKFGSGYVSGWGRVFHKGYSALVLQYLRVPLVDRATCLESTKFTIYNNMFCAGFHEGGRDSCQGDSGGPHVTEVEGTSFLTGIISWGEECAMKGKYGIYTKVSEYVNWIKNKTKLT

SEQ ID NO: 235 - protein, 415 aa, Artificial Sequence
  Factor IX A103N/N105S/Y155F/R318Y/R338E/R403E/E410N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSNDSKVVCSCTEGYRLAENQKSCEPAVPFPCGRVSVSQTSKLTRAETVFPDVDFVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGYSALVLQYLRVPLVDRATCLESTKFTIYNNMFCAGFHEGGRDSCQGDSGGPHVTEVEGTSFLTGIISWGEECAMKGKYGIYTKVSEYVNWIKNKTKLT

SEQ ID NO: 236 - protein, 415 aa, Artificial Sequence
  Factor IX D104N/K106S/Y155F/R318Y/R338E/R403E/E410N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSANNSVVCSCTEGYRLAENQKSCEPAVPFPCGRVSVSQTSKLTRAETVFPDVDFVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGYSALVLQYLRVPLVDRATCLESTKFTIYNNMFCAGFHEGGRDSCQGDSGGPHVTEVEGTSFLTGIISWGEECAMKGKYGIYTKVSEYVNWIKNKTKLT

SEQ ID NO: 237 - protein, 415 aa, Artificial Sequence
  Factor IX Y155F/K228N/R318Y/R338E/R403E/E410N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDFVNSTEAETILDNITQSTQSFNDFTRVVGGEDAKPGQFPWQVVLNGKVDAFCGGSIVNEKWIVTAAHCVETGVNITVVAGEHNIEETEHTEQKRNVIRIIPHHNYNAAINKYNHDIALLELDEPLVLNSYVTPICIADKEYTNIFLKFGSGYVSGWGRVFHKGYSALVLQYLRVPLVDRATCLESTKFTIYNNMFCAGFHEGGRDSCQGDSGGPHVTEVEGTSFLTGIISWGEECAMKGKYGIYTKVSEYVNWIKNKTKLT

SEQ ID NO: 238 - protein, 415 aa, Artificial Sequence
  Factor IX Y155F/I251S/R318Y/R338E/R403E/E410N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDFVNSTEAETILDNITQSTQSFNDFTRVVGGEDAKPGQFPWQVVLNGKVDAFCGGSIVNEKWIVTAAHCVETGVKITVVAGEHNIEETEHTEQKRNVSRIIPHHNYNAAINKYNHDIALLELDEPLVLNSYVTPICIADKEYTNIFLKFGSGYVSGWGRVFHKGYSALVLQYLRVPLVDRATCLESTKFTIYNNMFCAGFHEGGRDSCQGDSGGPHVTEVEGTSFLTGIISWGEECAMKGKYGIYTKVSEYVNWIKNKTKLT

SEQ ID NO: 239 - protein, 415 aa, Artificial Sequence
  Factor IX Y155F/K247N/N249S/R318Y/R338E/R403E/E410N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDFVNSTEAETILDNITQSTQSFNDFTRVVGGEDAKPGQFPWQVVLNGKVDAFCGGSIVNEKWIVTAAHCVETGVKITVVAGEHNIEETEHTEQNRSVIRIIPHHNYNAAINKYNHDIALLELDEPLVLNSYVTPICIADKEYTNIFLKFGSGYVSGWGRVFHKGYSALVLQYLRVPLVDRATCLESTKFTIYNNMFCAGFHEGGRDSCQGDSGGPHVTEVEGTSFLTGIISWGEECAMKGKYGIYTKVSEYVNWIKNKTKLT

SEQ ID NO: 240 - protein, 415 aa, Artificial Sequence
  Factor IX K247N/N249S/R318Y/R338E/R403E/E410N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQNRSVIRIIPHHNYNAAINKYNHDIALLELDEPLVLNSYVTPICIADKEYTNIFLKFGSGYVSGWGRVFHKGYSALVLQYLRVPLVDRATCLESTKFTIYNNMFCAGFHEGGRDSCQGDSGGPHVTEVEGTSFLTGIISWGEECAMKGKYGIYTKVSEYVNWIKNKTKLT

SEQ ID NO: 241 - protein, 415 aa, Artificial Sequence
  Factor IX Y155F/R318Y/R338E/R403E/E410N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDFVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGYSALVLQYLRVPLVDRATCLESTKFTIYNNMFCAGFHEGGRDSCQGDSGGPHVTEVEGTSFLTGIISWGEECAMKGKYGIYTKVSEYVNWIKNKTKLT

SEQ ID NO: 242 - protein, 415 aa, Artificial Sequence
  Factor IX K247N/N249S/R318Y/R338E/E410N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQNRSVIRIIPHHNYNAAINKYNHDIALLELDEPLVLNSYVTPICIADKEYTNIFLKFGSGYVSGWGRVFHKGYSALVLQYLRVPLVDRATCLESTKFTIYNNMFCAGFHEGGRDSCQGDSGGPHVTEVEGTSFLTGIISWGEECAMKGKYGIYTKVSRYVNWIKNKTKLT

SEQ ID NO: 243 - protein, 415 aa, Artificial Sequence
  Factor IX Y155F/R318Y/R338E/E410N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDFVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGYSALVLQYLRVPLVDRATCLESTKFTIYNNMFCAGFHEGGRDSCQGDSGGPHVTEVEGTSFLTGIISWGEECAMKGKYGIYTKVSRYVNWIKNKTKLT

SEQ ID NO: 244 - protein, 415 aa, Artificial Sequence
  Factor IX Y155F/K247N/N249S/R318Y/R338E/E410N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDFVNSTEAETILDNITQSTQSFNDFTRVVGGEDAKPGQFPWQVVLNGKVDAFCGGSIVNEKWIVTAAHCVETGVKITVVAGEHNIEETEHTEQNRSVIRIIPHHNYNAAINKYNHDIALLELDEPLVLNSYVTPICIADKEYTNIFLKFGSGYVSGWGRVFHKGYSALVLQYLRVPLVDRATCLESTKFTIYNNMFCAGFHEGGRDSCQGDSGGPHVTEVEGTSFLTGIISWGEECAMKGKYGIYTKVSRYVNWIKNKTKLT

SEQ ID NO: 245 - protein, 415 aa, Artificial Sequence
  Factor IX D104N/K106S/Y155F/K228N/K247N/N249S
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSANNSVVCSCTEGYRLAENQKSCEPAVPFPCGRVSVSQTSKLTRAETVFPDVDFVNSTEAETILDNITQSTQSFNDFTRVVGGEDAKPGQFPWQVVLNGKVDAFCGGSIVNEKWIVTAAHCVETGVNITVVAGEHNIEETEHTEQNRSVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 246 - protein, 415 aa, Artificial Sequence
  Factor IX D104N/K106S/Y155F/K247N/N249S
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSANNSVVCSCTEGYRLAENQKSCEPAVPFPCGRVSVSQTSKLTRAETVFPDVDFVNSTEAETILDNITQSTQSFNDFTRVVGGEDAKPGQFPWQVVLNGKVDAFCGGSIVNEKWIVTAAHCVETGVKITVVAGEHNIEETEHTEQNRSVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 247 - protein, 415 aa, Artificial Sequence
  Factor IX D104N/K106S/Y155F/K228N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSANNSVVCSCTEGYRLAENQKSCEPAVPFPCGRVSVSQTSKLTRAETVFPDVDFVNSTEAETILDNITQSTQSFNDFTRVVGGEDAKPGQFPWQVVLNGKVDAFCGGSIVNEKWIVTAAHCVETGVNITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 248 - protein, 415 aa, Artificial Sequence
  Factor IX Y155F/K228N/K247N/N249S
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDFVNSTEAETILDNITQSTQSFNDFTRVVGGEDAKPGQFPWQVVLNGKVDAFCGGSIVNEKWIVTAAHCVETGVNITVVAGEHNIEETEHTEQNRSVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 249 - protein, 415 aa, Artificial Sequence
  Factor IX R318Y/R338E/R403E/E410S
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGYSALVLQYLRVPLVDRATCLESTKFTIYNNMFCAGFHEGGRDSCQGDSGGPHVTEVEGTSFLTGIISWGEECAMKGKYGIYTKVSEYVNWIKSKTKLT

SEQ ID NO: 250 - protein, 415 aa, Artificial Sequence
  Factor IX R318Y/R338E/R403E/E410N/T412V
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGYSALVLQYLRVPLVDRATCLESTKFTIYNNMFCAGFHEGGRDSCQGDSGGPHVTEVEGTSFLTGIISWGEECAMKGKYGIYTKVSEYVNWIKNKVKLT

SEQ ID NO: 251 - protein, 415 aa, Artificial Sequence
  Factor IX R318Y/R338E/R403E/E410N/T412A
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGYSALVLQYLRVPLVDRATCLESTKFTIYNNMFCAGFHEGGRDSCQGDSGGPHVTEVEGTSFLTGIISWGEECAMKGKYGIYTKVSEYVNWIKNKAKLT

SEQ ID NO: 252 - protein, 415 aa, Artificial Sequence
  Factor IX R318Y/R338E/R403E/T412A
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGYSALVLQYLRVPLVDRATCLESTKFTIYNNMFCAGFHEGGRDSCQGDSGGPHVTEVEGTSFLTGIISWGEECAMKGKYGIYTKVSEYVNWIKEKAKLT

SEQ ID NO: 253 - protein, 415 aa, Artificial Sequence
  Factor IX R318Y/R338E/E410S
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGYSALVLQYLRVPLVDRATCLESTKFTIYNNMFCAGFHEGGRDSCQGDSGGPHVTEVEGTSFLTGIISWGEECAMKGKYGIYTKVSRYVNWIKSKTKLT

SEQ ID NO: 254 - protein, 415 aa, Artificial Sequence
  Factor IX R318Y/R338E/T412A
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGYSALVLQYLRVPLVDRATCLESTKFTIYNNMFCAGFHEGGRDSCQGDSGGPHVTEVEGTSFLTGIISWGEECAMKGKYGIYTKVSRYVNWIKEKAKLT

SEQ ID NO: 255 - protein, 415 aa, Artificial Sequence
  Factor IX R318Y/R338E/E410N/T412V
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGYSALVLQYLRVPLVDRATCLESTKFTIYNNMFCAGFHEGGRDSCQGDSGGPHVTEVEGTSFLTGIISWGEECAMKGKYGIYTKVSRYVNWIKNKVKLT

SEQ ID NO: 256 - protein, 415 aa, Artificial Sequence
  Factor IX D85N/K228N/R318Y/R338E/R403E/E410N
YNSGKLEEFVQGNLERECMEEKCSFEEAREVFENTERTTEFWKQYVDGDQCESNPCLNGGSCKDDINSYECWCPFGFEGKNCELNVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVNITVVAGEHNIEETEHTEQKRNVIRIIPHHNYNAAINKYNHDIALLELDEPLVLNSYVTPICIADKEYTNIFLKFGSGYVSGWGRVFHKGYSALVLQYLRVPLVDRATCLESTKFTIYNNMFCAGFHEGGRDSCQGDSGGPHVTEVEGTSFLTGIISWGEECAMKGKYGIYTKVSEYVNWIKNKTKLT

SEQ ID NO: 257 - protein, 415 aa, Artificial Sequence
  Factor IX N260S/R318Y/R338E/R403E/E410N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYSAAINKYNHDIALLELDEPLVLNSYVTPICIADKEYTNIFLKFGSGYVSGWGRVFHKGYSALVLQYLRVPLVDRATCLESTKFTIYNNMFCAGFHEGGRDSCQGDSGGPHVTEVEGTSFLTGIISWGEECAMKGKYGIYTKVSEYVNWIKNKTKLT

SEQ ID NO: 258 - protein, 415 aa, Artificial Sequence
  Factor IX R318Y/R338E/N346D/R403E/E410N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGYSALVLQYLRVPLVDRATCLESTKFTIYDNMFCAGFHEGGRDSCQGDSGGPHVTEVEGTSFLTGIISWGEECAMKGKYGIYTKVSEYVNWIKNKTKLT

SEQ ID NO: 259 - protein, 415 aa, Artificial Sequence
  Factor IX Y155F/N346D
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDFVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYDNMFCAGFHEGGRDSCQGDSGGPHVTEVEGTSFLTGIISWGEECAMKGKYGIYTKVSRYVNWIKEKTKLT

SEQ ID NO: 260 - protein, 415 aa, Artificial Sequence
  Factor IX Y155F/R318Y/R338E/N346D/R403E/E410N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDFVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGYSALVLQYLRVPLVDRATCLESTKFTIYDNMFCAGFHEGGRDSCQGDSGGPHVTEVEGTSFLTGIISWGEECAMKGKYGIYTKVSEYVNWIKNKTKLT

SEQ ID NO: 261 - protein, 415 aa, Artificial Sequence
  Factor IX Y155F/N260S/N346D
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDFVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYSAAINKYNHDIALLELDEPLVLNSYVTPICIADKEYTNIFLKFGSGYVSGWGRVFHKGRSALVLQYLRVPLVDRATCLRSTKFTIYDNMFCAGFHEGGRDSCQGDSGGPHVTEVEGTSFLTGIISWGEECAMKGKYGIYTKVSRYVNWIKEKTKLT

SEQ ID NO: 262 - protein, 415 aa, Artificial Sequence
  Factor IX K247N/N249S/N260S
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQNRSVIRIIPHHNYSAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 263 - protein, 415 aa, Artificial Sequence
  Factor IX Y155F/N260S
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDFVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYSAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 264 - protein, 415 aa, Artificial Sequence
  Factor IX K247N/N249S/N260S/R318Y/R338E/R403E/E410N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQNRSVIRIIPHHNYSAAINKYNHDIALLELDEPLVLNSYVTPICIADKEYTNIFLKFGSGYVSGWGRVFHKGYSALVLQYLRVPLVDRATCLESTKFTIYNNMFCAGFHEGGRDSCQGDSGGPHVTEVEGTSFLTGIISWGEECAMKGKYGIYTKVSEYVNWIKNKTKLT

SEQ ID NO: 265 - protein, 415 aa, Artificial Sequence
  Factor IX D104N/K106S/N260S/R318Y/R338E/R403E/E410N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSANNSVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYSAAINKYNHDIALLELDEPLVLNSYVTPICIADKEYTNIFLKFGSGYVSGWGRVFHKGYSALVLQYLRVPLVDRATCLESTKFTIYNNMFCAGFHEGGRDSCQGDSGGPHVTEVEGTSFLTGIISWGEECAMKGKYGIYTKVSEYVNWIKNKTKLT

SEQ ID NO: 266 - protein, 415 aa, Artificial Sequence
  Factor IX Y155F/N260S/R318Y/R338E/R403E/E410N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDFVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYSAAINKYNHDIALLELDEPLVLNSYVTPICIADKEYTNIFLKFGSGYVSGWGRVFHKGYSALVLQYLRVPLVDRATCLESTKFTIYNNMFCAGFHEGGRDSCQGDSGGPHVTEVEGTSFLTGIISWGEECAMKGKYGIYTKVSEYVNWIKNKTKLT

SEQ ID NO: 267 - protein, 415 aa, Artificial Sequence
  Factor IX R318Y/R338E/T343R/R403E/E410N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGYSALVLQYLRVPLVDRATCLESTKFRIYNNMFCAGFHEGGRDSCQGDSGGPHVTEVEGTSFLTGIISWGEECAMKGKYGIYTKVSEYVNWIKNKTKLT

SEQ ID NO: 268 - protein, 415 aa, Artificial Sequence
  Factor IX R338E/T343R
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLESTKFRIYNNMFCAGFHEGGRDSCQGDSGGPHVTEVEGTSFLTGIISWGEECAMKGKYGIYTKVSRYVNWIKEKTKLT

SEQ ID NO: 269 - protein, 415 aa, Artificial Sequence
  Factor IX D104N/K106S/Y155F/N260S
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSANNSVVCSCTEGYRLAENQKSCEPAVPFPCGRVSVSQTSKLTRAETVFPDVDFVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYSAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 270 - protein, 415 aa, Artificial Sequence
  Factor IX Y155F/K247N/N249S/N260S
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDFVNSTEAETILDNITQSTQSFNDFTRVVGGEDAKPGQFPWQVVLNGKVDAFCGGSIVNEKWIVTAAHCVETGVKITVVAGEHNIEETEHTEQNRSVIRIIPHHNYSAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 271 - protein, 415 aa, Artificial Sequence
  Factor IX D104N/K106S/K247N/N249S/N260S
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSANNSVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQNRSVIRIIPHHNYSAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 272 - protein, 415 aa, Artificial Sequence
  Factor IX D104N/K106S/Y155F/K247N/N249S/N260S
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSANNSVVCSCTEGYRLAENQKSCEPAVPFPCGRVSVSQTSKLTRAETVFPDVDFVNSTEAETILDNITQSTQSFNDFTRVVGGEDAKPGQFPWQVVLNGKVDAFCGGSIVNEKWIVTAAHCVETGVKITVVAGEHNIEETEHTEQNRSVIRIIPHHNYSAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 273 - DNA, 34 bp, Artificial Sequence
  F9-D[64]N-For
ggcggcagttgcaagaacgacattaattcctatg

SEQ ID NO: 274 - DNA, 34 bp, Artificial Sequence
  F9-D[64]A-For
ggcggcagttgcaaggctgacattaattcctatg

SEQ ID NO: 275 - DNA, 39 bp, Artificial Sequence
  F9-N[157]Q-For
cctgatgtggactatgtacagtctactgaagctgaaacc

SEQ ID NO: 276 - DNA, 39 bp, Artificial Sequence
  F9-N[157]D-For
cctgatgtggactatgtagactctactgaagctgaaacc

SEQ ID NO: 277 - DNA, 33 bp, Artificial Sequence
  F9-N[167]Q-For
gaaaccattttggatcagatcactcaaagcacc

SEQ ID NO: 278 - DNA, 33 bp, Artificial Sequence
  F9-N[167]D-For
gaaaccattttggatgacatcactcaaagcacc

SEQ ID NO: 279 - DNA, 42 bp, Artificial Sequence
  F9-S[61]A-For
ccatgtttaaatggcggcgcttgcaaggatgacattaattcc

SEQ ID NO: 280 - DNA, 39 bp, Artificial Sequence
  F9-S[53]A-For
gatggagatcagtgtgaggctaatccatgtttaaatggc

SEQ ID NO: 281 - DNA, 39 bp, Artificial Sequence
  F9-T[159]A-For
gtggactatgtaaattctgctgaagctgaaaccattttg

SEQ ID NO: 282 - DNA, 43 bp, Artificial Sequence
  F9-T[169]A-For
cattttggataacatcgctcaaagcacccaatcatttaatgac

SEQ ID NO: 283 - DNA, 36 bp, Artificial Sequence
  F9-T[172]A-For
gataacatcactcaaagcgctcaatcatttaatgac

SEQ ID NO: 284 - DNA, 40 bp, Artificial Sequence
  F9-T[179]A-For
caatcatttaatgacttcgctcgggttgttggtggagaag

SEQ ID NO: 285 - DNA, 40 bp, Artificial Sequence
  F9-Y[155]F-For
gtttttcctgatgtggacttcgtaaattctactgaagctg

SEQ ID NO: 286 - DNA, 40 bp, Artificial Sequence
  F9-Y[155]H-For
gtttttcctgatgtggaccacgtaaattctactgaagctg

SEQ ID NO: 287 - DNA, 40 bp, Artificial Sequence
  F9-Y[155]Q-For
gtttttcctgatgtggaccaggtaaattctactgaagctg

SEQ ID NO: 288 - DNA, 33 bp, Artificial Sequence
  F9-S[158]A-For
gtggactatgtaaatgctactgaagctgaaacc

SEQ ID NO: 289 - DNA, 33 bp, Artificial Sequence
  F9-S[158]D-For
gtggactatgtaaatgacactgaagctgaaacc

SEQ ID NO: 290 - DNA, 33 bp, Artificial Sequence
  F9-S[158]E-For
gtggactatgtaaatgagactgaagctgaaacc

SEQ ID NO: 291 - DNA, 36 bp, Artificial Sequence
  F9-R165S-For
gttccacttgttgacagcgccacatgtcttcgatct

SEQ ID NO: 292 - DNA, 33 bp, Artificial Sequence
  F9-R170L-For
cgagccacatgtcttctgtctacaaagttcacc

SEQ ID NO: 293 - DNA, 34 bp, Artificial Sequence
  F9-K148N-For
ggaagagtcttccacaacgggagatcagctttag

SEQ ID NO: 294 - DNA, 34 bp, Artificial Sequence
  F9-K148A-For
ggaagagtcttccacgctgggagatcagctttag

SEQ ID NO: 295 - DNA, 34 bp, Artificial Sequence
  F9-K148E-For
ggaagagtcttccacgaggggagatcagctttag

SEQ ID NO: 296 - DNA, 34 bp, Artificial Sequence
  F9-K148S-For
ggaagagtcttccacagcgggagatcagctttag

SEQ ID NO: 297 - DNA, 34 bp, Artificial Sequence
  F9-K148M-For
ggaagagtcttccacatggggagatcagctttag

SEQ ID NO: 298 - DNA, 34 bp, Artificial Sequence
  F9-E74S-For
ggtgaacataatattagcgagacagaacatacag

SEQ ID NO: 299 - DNA, 34 bp, Artificial Sequence
  F9-E74A-For
ggtgaacataatattgctgagacagaacatacag

SEQ ID NO: 300 - DNA, 34 bp, Artificial Sequence
  F9-E74R-For
ggtgaacataatattagggagacagaacatacag

SEQ ID NO: 301 - DNA, 34 bp, Artificial Sequence
  F9-E74K-For
ggtgaacataatattaaggagacagaacatacag

SEQ ID NO: 302 - DNA, 32 bp, Artificial Sequence
  F9-H92F-For-Corr
cgaattattcctcacttcaactacaatgcagc

SEQ ID NO: 303 - DNA, 32 bp, Artificial Sequence
  F9-H92Y-For-Corr
cgaattattcctcactacaactacaatgcagc

SEQ ID NO: 304 - DNA, 32 bp, Artificial Sequence
  F9-H92E-For-Corr
cgaattattcctcacgaaaactacaatgcagc

SEQ ID NO: 305 - DNA, 32 bp, Artificial Sequence
  F9-H92S-For-Corr
cgaattattcctcacagcaactacaatgcagc

SEQ ID NO: 306 - DNA, 34 bp, Artificial Sequence
  F9-T242A-For
ctggattaaggaaaaagctaagctcacttaagtg

SEQ ID NO: 307 - DNA, 34 bp, Artificial Sequence
  F9-T242V-For
ctggattaaggaaaaagtgaagctcacttaagtg

SEQ ID NO: 308 - DNA, 39 bp, Artificial Sequence
  F9-E240N/T242A-For
gtcaactggattaagaacaaagctaagctcacttaagtg

SEQ ID NO: 309 - DNA, 39 bp, Artificial Sequence
  F9-E240N/T242V-For
gtcaactggattaagaacaaagtgaagctcacttaagtg

SEQ ID NO: 310 - DNA, 37 bp, Artificial Sequence
  F9-E240Q-For
gtcaactggattaagcagaaaacaaagctcacttaag

SEQ ID NO: 311 - DNA, 37 bp, Artificial Sequence
  F9-E240S-For
gtcaactggattaagagcaaaacaaagctcacttaag

SEQ ID NO: 312 - DNA, 37 bp, Artificial Sequence
  F9-E240A-For
gtcaactggattaaggctaaaacaaagctcacttaag

SEQ ID NO: 313 - DNA, 37 bp, Artificial Sequence
  F9-E240D-For
gtcaactggattaaggacaaaacaaagctcacttaag

SEQ ID NO: 314 - DNA, 38 bp, Artificial Sequence
  F9-N178D-For
caaagttcaccatctatgacaacatgttctgtgctggc

SEQ ID NO: 315 - DNA, 38 bp, Artificial Sequence
  F9-N178Y-For
caaagttcaccatctattacaacatgttctgtgctggc

SEQ ID NO: 316 - DNA, 37 bp, Artificial Sequence
  F9-Y177A-For
ctacaaagttcaccatcgctaacaacatgttctgtgc

SEQ ID NO: 317 - DNA, 37 bp, Artificial Sequence
  F9-Y177T-For
ctacaaagttcaccatcaccaacaacatgttctgtgc

SEQ ID NO: 318 - DNA, 39 bp, Artificial Sequence
  F9-T175R-For
cttcgatctacaaagttcaggatctataacaacatgttc

SEQ ID NO: 319 - DNA, 39 bp, Artificial Sequence
  F9-T175E-For
cttcgatctacaaagttcgaaatctataacaacatgttc

SEQ ID NO: 320 - DNA, 39 bp, Artificial Sequence
  F9-T175Q-For
cttcgatctacaaagttccagatctataacaacatgttc

SEQ ID NO: 321 - DNA, 38 bp, Artificial Sequence
  F9-F174I/Y177T-For
gtcttcgatctacaaagatcaccatctataacaacatg

SEQ ID NO: 322 - DNA, 40 bp, Artificial Sequence
  F9-T175R/Y177T-For
cgatctacaaagttcaggatcaccaacaacatgttctgtg

SEQ ID NO: 323 - DNA, 57 bp, Artificial Sequence
  F9-Y94F/K98T-For
gaattattcctcaccacaacttcaatgcagctattaatacctacaaccatgacattg

SEQ ID NO: 324 - DNA, 40 bp, Artificial Sequence
  F9-F145N/K148S-For
ggctggggaagagtcaaccacagcgggagatcagctttag

SEQ ID NO: 325 - protein, 461 aa, Homo sapiens [sequence omitted]

SEQ ID NO: 326 - protein, 415 aa, Homo sapiens
  Factor IX D104N/K106S/Y155F/K247N/ N249S/R318Y/R338E/R403E/E410N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSANNSVVCSCTEGYRLAENQKSCEPAVPFPCGRVSVSQTSKLTRAETVFPDVDFVNSTEAETILDNITQSTQSFNDFTRVVGGEDAKPGQFPWQVVLNGKVDAFCGGSIVNEKWIVTAAHCVETGVKITVVAGEHNIEETEHTEQNRSVIRIIPHHNYNAAINKYNHDIALLELDEPLVLNSYVTPICIADKEYTNIFLKFGSGYVSGWGRVFHKGYSALVLQYLRVPLVDRATCLESTKFTIYNNMFCAGFHEGGRDSCQGDSGGPHVTEVEGTSFLTGIISWGEECAMKGKYGIYTKVSEYVNWIKNKTKLT

SEQ ID NO: 327 - protein, 415 aa, Homo sapiens
  Factor IX D104N/K106S/K228N/K247N/ N249S/R318Y/R338E/R403E/E410N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSANNSVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVNITVVAGEHNIEETEHTEQNRSVIRIIPHHNYNAAINKYNHDIALLELDEPLVLNSYVTPICIADKEYTNIFLKFGSGYVSGWGRVFHKGYSALVLQYLRVPLVDRATCLESTKFTIYNNMFCAGFHEGGRDSCQGDSGGPHVTEVEGTSFLTGIISWGEECAMKGKYGIYTKVSEYVNWIKNKTKLT

SEQ ID NO: 328 - protein, 415 aa, Homo sapiens
  Factor IX Y155F/K228N/K247N/N249S/ R318Y/R338E/R403E/E410N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDFVNSTEAETILDNITQSTQSFNDFTRVVGGEDAKPGQFPWQVVLNGKVDAFCGGSIVNEKWIVTAAHCVETGVNITVVAGEHNIEETEHTEQNRSVIRIIPHHNYNAAINKYNHDIALLELDEPLVLNSYVTPICIADKEYTNIFLKFGSGYVSGWGRVFHKGYSALVLQYLRVPLVDRATCLESTKFTIYNNMFCAGFHEGGRDSCQGDSGGPHVTEVEGTSFLTGIISWGEECAMKGKYGIYTKVSEYVNWIKNKTKLT

SEQ ID NO: 329 - protein, 415 aa, Homo sapiens
  Factor IX Y155F/K247N/N249S/N260S/ R318Y/R338E/R403E/E410N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDFVNSTEAETILDNITQSTQSFNDFTRVVGGEDAKPGQFPWQVVLNGKVDAFCGGSIVNEKWIVTAAHCVETGVKITVVAGEHNIEETEHTEQNRSVIRIIPHHNYSAAINKYNHDIALLELDEPLVLNSYVTPICIADKEYTNIFLKFGSGYVSGWGRVFHKGYSALVLQYLRVPLVDRATCLESTKFTIYNNMFCAGFHEGGRDSCQGDSGGPHVTEVEGTSFLTGIISWGEECAMKGKYGIYTKVSEYVNWIKNKTKLT

SEQ ID NO: 330 - protein, 415 aa, Homo sapiens
  Factor IX Y155F/R318Y/R338E/T343R/R403E/E410N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDFVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGYSALVLQYLRVPLVDRATCLESTKFRIYNNMFCAGFHEGGRDSCQGDSGGPHVTEVEGTSFLTGIISWGEECAMKGKYGIYTKVSEYVNWIKNKTKLT

SEQ ID NO: 331 - protein, 415 aa, Homo sapeins
  Factor IX D104N/K106S/R318Y/R338E/T343R/R403E/E410N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSANNSVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGYSALVLQYLRVPLVDRATCLESTKFRIYNNMFCAGFHEGGRDSCQGDSGGPHVTEVEGTSFLTGIISWGEECAMKGKYGIYTKVSEYVNWIKNKTKLT

SEQ ID NO: 332 - protein, 415 aa, Homo sapiens
  Factor IX T343R/N346Y
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFRIYYNMFCAGFHEGGRDSCQGDSGGPHVTEVEGTSFLTGIISWGEECAMKGKYGIYTKVSRYVNWIKEKTKLT

SEQ ID NO: 333 - protein, 415 aa, Homo sapiens
  Factor IX R318Y/R338E/N346Y/R403E/E410N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGYSALVLQYLRVPLVDRATCLESTKFTIYYNMFCAGFHEGGRDSCQGDSGGPHVTEVEGTSFLTGIISWGEECAMKGKYGIYTKVSEYVNWIKNKTKLT

SEQ ID NO: 334 - protein, 415 aa, Homo sapiens
  Factor IX R318Y/R338E/T343R/N346Y/R403E/E410N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGYSALVLQYLRVPLVDRATCLESTKFRIYYNMFCAGFHEGGRDSCQGDSGGPHVTEVEGTSFLTGIISWGEECAMKGKYGIYTKVSEYVNWIKNKTKLT

SEQ ID NO: 335 - protein, 415 aa, Homo sapiens
  Factor IX T343R/N346D
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFRIYDNMFCAGFHEGGRDSCQGDSGGPHVTEVEGTSFLTGIISWGEECAMKGKYGIYTKVSRYVNWIKEKTKLT

SEQ ID NO: 336 - protein, 415 aa, Homo sapiens
  Factor IX R318Y/R338E/T343R/N346D/R403E/E410N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGYSALVLQYLRVPLVDRATCLESTKFRIYDNMFCAGFHEGGRDSCQGDSGGPHVTEVEGTSFLTGIISWGEECAMKGKYGIYTKVSEYVNWIKNKTKLT

SEQ ID NO: 337 - protein, 415 aa, Homo sapiens
  Factor IX R318Y/R338E/Y345A/R403E/E410N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGYSALVLQYLRVPLVDRATCLESTKFTIANNMFCAGFHEGGRDSCQGDSGGPHVTEVEGTSFLTGIISWGEECAMKGKYGIYTKVSEYVNWIKNKTKLT

SEQ ID NO: 338 - protein, 415 aa, Homo sapiens
  Factor IX R318Y/R338E/Y345A/N346D/R403E/E410N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGYSALVLQYLRVPLVDRATCLESTKFTIADNMFCAGFHEGGRDSCQGDSGGPHVTEVEGTSFLTGIISWGEECAMKGKYGIYTKVSEYVNWIKNKTKLT

SEQ ID NO: 339 - protein, 415 aa, Homo sapiens
  Factor IX Y155F/K247N/N249S/R318Y/R338E/R403E
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDFVNSTEAETILDNITQSTQSFNDFTRVVGGEDAKPGQFPWQVVLNGKVDAFCGGSIVNEKWIVTAAHCVETGVKITVVAGEHNIEETEHTEQNRSVIRIIPHHNYNAAINKYNHDIALLELDEPLVLNSYVTPICIADKEYTNIFLKFGSGYVSGWGRVFHKGYSALVLQYLRVPLVDRATCLESTKFTIYNNMFCAGFHEGGRDSCQGDSGGPHVTEVEGTSFLTGIISWGEECAMKGKYGIYTKVSEYVNWIKEKTKLT

SEQ ID NO: 340 - protein, 415 aa, Homo sapiens
  Factor IX K247N/N249S/R318Y/R338E/R403E
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQNRSVIRIIPHHNYNAAINKYNHDIALLELDEPLVLNSYVTPICIADKEYTNIFLKFGSGYVSGWGRVFHKGYSALVLQYLRVPLVDRATCLESTKFTIYNNMFCAGFHEGGRDSCQGDSGGPHVTEVEGTSFLTGIISWGEECAMKGKYGIYTKVSEYVNWIKEKTKLT

SEQ ID NO: 341 - protein, 415 aa, Homo sapiens
  Factor IX Y155F/K247N/N249S/R318Y/R403E/E410N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDFVNSTEAETILDNITQSTQSFNDFTRVVGGEDAKPGQFPWQVVLNGKVDAFCGGSIVNEKWIVTAAHCVETGVKITVVAGEHNIEETEHTEQNRSVIRIIPHHNYNAAINKYNHDIALLELDEPLVLNSYVTPICIADKEYTNIFLKFGSGYVSGWGRVFHKGYSALVLQYLRVPLVDRATCLRSTKFTIYNNMFCAGFHEGGRDSCQGDSGGPHVTEVEGTSFLTGIISWGEECAMKGKYGIYTKVSEYVNWIKNKTKLT

SEQ ID NO: 342 - protein, 415 aa, Homo sapiens
  Factor IX K247N/N249S/R318Y/R403E/E410N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQNRSVIRIIPHHNYNAAINKYNHDIALLELDEPLVLNSYVTPICIADKEYTNIFLKFGSGYVSGWGRVFHKGYSALVLQYLRVPLVDRATCLRSTKFTIYNNMFCAGFHEGGRDSCQGDSGGPHVTEVEGTSFLTGIISWGEECAMKGKYGIYTKVSEYVNWIKNKTKLT

SEQ ID NO: 343 - protein, 415 aa, Homo sapiens
  Factor IX Y155F/K247N/N249S/R338E/R403E/E410N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDFVNSTEAETILDNITQSTQSFNDFTRVVGGEDAKPGQFPWQVVLNGKVDAFCGGSIVNEKWIVTAAHCVETGVKITVVAGEHNIEETEHTEQNRSVIRIIPHHNYNAAINKYNHDIALLELDEPLVLNSYVTPICIADKEYTNIFLKFGSGYVSGWGRVFHKGRSALVLQYLRVPLVDRATCLESTKFTIYNNMFCAGFHEGGRDSCQGDSGGPHVTEVEGTSFLTGIISWGEECAMKGKYGIYTKVSEYVNWIKNKTKLT

SEQ ID NO: 344 - protein, 415 aa, Homo sapiens
  Factor IX K247N/N249S/R338E/R403E/E410N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQNRSVIRIIPHHNYNAAINKYNHDIALLELDEPLVLNSYVTPICIADKEYTNIFLKFGSGYVSGWGRVFHKGRSALVLQYLRVPLVDRATCLESTKFTIYNNMFCAGFHEGGRDSCQGDSGGPHVTEVEGTSFLTGIISWGEECAMKGKYGIYTKVSEYVNWIKNKTKLT

SEQ ID NO: 345 - protein, 415 aa, Homo sapiens
  Factor IX R318Y/R338E/T343R/R403E
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGYSALVLQYLRVPLVDRATCLESTKFRIYNNMFCAGFHEGGRDSCQGDSGGPHVTEVEGTSFLTGIISWGEECAMKGKYGIYTKVSEYVNWIKEKTKLT

SEQ ID NO: 346 - protein, 415 aa, Homo sapiens
  Factor IX Y155F/R318Y/R338E/T343R/R403E
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDFVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGYSALVLQYLRVPLVDRATCLESTKFRIYNNMFCAGFHEGGRDSCQGDSGGPHVTEVEGTSFLTGIISWGEECAMKGKYGIYTKVSEYVNWIKEKTKLT

SEQ ID NO: 347 - protein, 415 aa, Homo sapiens
  Factor IX R318Y/R338E/T343R/E410N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGYSALVLQYLRVPLVDRATCLESTKFRIYNNMFCAGFHEGGRDSCQGDSGGPHVTEVEGTSFLTGIISWGEECAMKGKYGIYTKVSRYVNWIKNKTKLT

SEQ ID NO: 348 - protein, 415 aa, Homo sapiens
  Factor IX Y155F/R318Y/R338E/T343R/E410N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDFVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGYSALVLQYLRVPLVDRATCLESTKFRIYNNMFCAGFHEGGRDSCQGDSGGPHVTEVEGTSFLTGIISWGEECAMKGKYGIYTKVSRYVNWIKNKTKLT

SEQ ID NO: 349 - protein, 415 aa, Homo sapiens
  Factor IX R318Y/T343R/R403E/E410N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGYSALVLQYLRVPLVDRATCLRSTKFRIYNNMFCAGFHEGGRDSCQGDSGGPHVTEVEGTSFLTGIISWGEECAMKGKYGIYTKVSEYVNWIKNKTKLT

SEQ ID NO: 350 - protein, 415 aa, Homo sapiens
  Factor IX Y155F/R318Y/T343R/R403E/E410N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDFVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGYSALVLQYLRVPLVDRATCLRSTKFRIYNNMFCAGFHEGGRDSCQGDSGGPHVTEVEGTSFLTGIISWGEECAMKGKYGIYTKVSEYVNWIKNKTKLT

SEQ ID NO: 351 - protein, 415 aa, Homo sapiens
  Factor IX R338E/T343R/R403E/E410N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLESTKFRIYNNMFCAGFHEGGRDSCQGDSGGPHVTEVEGTSFLTGIISWGEECAMKGKYGIYTKVSEYVNWIKNKTKLT

SEQ ID NO: 352 - protein, 415 aa, Homo sapiens
  Factor IX Y155F/R338E/T343R/R403E/E410N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDFVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLESTKFRIYNNMFCAGFHEGGRDSCQGDSGGPHVTEVEGTSFLTGIISWGEECAMKGKYGIYTKVSEYVNWIKNKTKLT

SEQ ID NO: 353 - protein, 415 aa, Homo sapiens
  Factor IX Y155F/K247N/N249S/R318Y/R338E/ T343R/R403E/E410N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDFVNSTEAETILDNITQSTQSFNDFTRVVGGEDAKPGQFPWQVVLNGKVDAFCGGSIVNEKWIVTAAHCVETGVKITVVAGEHNIEETEHTEQNRSVIRIIPHHNYNAAINKYNHDIALLELDEPLVLNSYVTPICIADKEYTNIFLKFGSGYVSGWGRVFHKGYSALVLQYLRVPLVDRATCLESTKFRIYNNMFCAGFHEGGRDSCQGDSGGPHVTEVEGTSFLTGIISWGEECAMKGKYGIYTKVSEYVNWIKNKTKLT

SEQ ID NO: 354 - protein, 415 aa, Homo sapiens
  Factor IX K247N/N249S/R318Y/R338E/T343R/R403E/E410N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQNRSVIRIIPHHNYNAAINKYNHDIALLELDEPLVLNSYVTPICIADKEYTNIFLKFGSGYVSGWGRVFHKGYSALVLQYLRVPLVDRATCLESTKFRIYNNMFCAGFHEGGRDSCQGDSGGPHVTEVEGTSFLTGIISWGEECAMKGKYGIYTKVSEYVNWIKNKTKLT

SEQ ID NO: 355 - protein, 415 aa, Homo sapiens
  Factor IX K228N/I251S/R318Y/R338E/R403E/E410N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVNITVVAGEHNIEETEHTEQKRNVSRIIPHHNYNAAINKYNHDIALLELDEPLVLNSYVTPICIADKEYTNIFLKFGSGYVSGWGRVFHKGYSALVLQYLRVPLVDRATCLESTKFTIYNNMFCAGFHEGGRDSCQGDSGGPHVTEVEGTSFLTGIISWGEECAMKGKYGIYTKVSEYVNWIKNKTKLT

SEQ ID NO: 356 - protein, 415 aa, Homo sapiens
  Factor IX Y155F/K228N/I251S/R318Y/R338E/R403E/E410N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDFVNSTEAETILDNITQSTQSFNDFTRVVGGEDAKPGQFPWQVVLNGKVDAFCGGSIVNEKWIVTAAHCVETGVNITVVAGEHNIEETEHTEQKRNVSRIIPHHNYNAAINKYNHDIALLELDEPLVLNSYVTPICIADKEYTNIFLKFGSGYVSGWGRVFHKGYSALVLQYLRVPLVDRATCLESTKFTIYNNMFCAGFHEGGRDSCQGDSGGPHVTEVEGTSFLTGIISWGEECAMKGKYGIYTKVSEYVNWIKNKTKLT

SEQ ID NO: 357 - protein, 415 aa, Homo sapiens
  Factor IX N260S/R318Y/R338E/T343R/R403E/E410N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYSAAINKYNHDIALLELDEPLVLNSYVTPICIADKEYTNIFLKFGSGYVSGWGRVFHKGYSALVLQYLRVPLVDRATCLESTKFRIYNNMFCAGFHEGGRDSCQGDSGGPHVTEVEGTSFLTGIISWGEECAMKGKYGIYTKVSEYVNWIKNKTKLT

SEQ ID NO: 358 - protein, 415 aa, Homo sapiens
  Factor IX Y155F/N260S/R318Y/R338E/T343R/ R403E/E410N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDFVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYSAAINKYNHDIALLELDEPLVLNSYVTPICIADKEYTNIFLKFGSGYVSGWGRVFHKGYSALVLQYLRVPLVDRATCLESTKFRIYNNMFCAGFHEGGRDSCQGDSGGPHVTEVEGTSFLTGIISWGEECAMKGKYGIYTKVSEYVNWIKNKTKLT

SEQ ID NO: 359 - protein, 415 aa, Homo sapiens
  Factor IX K228N/K247N/N249S/R318Y/R338E/ T343R/R403E/E410N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVNITVVAGEHNIEETEHTEQNRSVIRIIPHHNYNAAINKYNHDIALLELDEPLVLNSYVTPICIADKEYTNIFLKFGSGYVSGWGRVFHKGYSALVLQYLRVPLVDRATCLESTKFRIYNNMFCAGFHEGGRDSCQGDSGGPHVTEVEGTSFLTGIISWGEECAMKGKYGIYTKVSEYVNWIKNKTKLT

SEQ ID NO: 360 - protein, 415 aa, Homo sapiens
  Factor IX Y155F/K228N/K247N/N249S/R318Y/ R338E/T343R/R403E/E410N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDFVNSTEAETILDNITQSTQSFNDFTRVVGGEDAKPGQFPWQVVLNGKVDAFCGGSIVNEKWIVTAAHCVETGVNITVVAGEHNIEETEHTEQNRSVIRIIPHHNYNAAINKYNHDIALLELDEPLVLNSYVTPICIADKEYTNIFLKFGSGYVSGWGRVFHKGYSALVLQYLRVPLVDRATCLESTKFRIYNNMFCAGFHEGGRDSCQGDSGGPHVTEVEGTSFLTGIISWGEECAMKGKYGIYTKVSEYVNWIKNKTKLT

SEQ ID NO: 361 - protein, 415 aa, Homo sapiens
  Factor IX Y155F/R338E/T343R/R403E
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDFVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLESTKFRIYNNMFCAGFHEGGRDSCQGDSGGPHVTEVEGTSFLTGIISWGEECAMKGKYGIYTKVSEYVNWIKEKTKLT

SEQ ID NO: 362 - protein, 415 aa, Homo sapiens
  Factor IX R338E/T343R/R403E
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLESTKFRIYNNMFCAGFHEGGRDSCQGDSGGPHVTEVEGTSFLTGIISWGEECAMKGKYGIYTKVSEYVNWIKEKTKLT

SEQ ID NO: 363 - protein, 415 aa, Homo sapiens
  Factor IX Y155F/R338E/T343R/R403E/E410S
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDFVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLESTKFRIYNNMFCAGFHEGGRDSCQGDSGGPHVTEVEGTSFLTGIISWGEECAMKGKYGIYTKVSEYVNWIKSKTKLT

SEQ ID NO: 364 - protein, 415 aa, Homo sapiens
  Factor IX Y155F/N260S/R338E/T343R/R403E
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDFVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYSAAINKYNHDIALLELDEPLVLNSYVTPICIADKEYTNIFLKFGSGYVSGWGRVFHKGRSALVLQYLRVPLVDRATCLESTKFRIYNNMFCAGFHEGGRDSCQGDSGGPHVTEVEGTSFLTGIISWGEECAMKGKYGIYTKVSEYVNWIKEKTKLT

SEQ ID NO: 365 - protein, 415 aa, Homo sapiens
  Factor IX Y155F/I251S/R338E/T343R/R403E
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDFVNSTEAETILDNITQSTQSFNDFTRVVGGEDAKPGQFPWQVVLNGKVDAFCGGSIVNEKWIVTAAHCVETGVKITVVAGEHNIEETEHTEQKRNVSRIIPHHNYNAAINKYNHDIALLELDEPLVLNSYVTPICIADKEYTNIFLKFGSGYVSGWGRVFHKGRSALVLQYLRVPLVDRATCLESTKFRIYNNMFCAGFHEGGRDSCQGDSGGPHVTEVEGTSFLTGIISWGEECAMKGKYGIYTKVSEYVNWIKEKTKLT

SEQ ID NO: 366 - protein, 415 aa, Homo sapiens
  Factor IX R318Y/R338E/T343R/R403E/E410S
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGYSALVLQYLRVPLVDRATCLESTKFRIYNNMFCAGFHEGGRDSCQGDSGGPHVTEVEGTSFLTGIISWGEECAMKGKYGIYTKVSEYVNWIKSKTKLT

SEQ ID NO: 367 - protein, 415 aa, Homo sapiens
  Factor IX Y155F/K247N/N249S/T343R/R403E
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDFVNSTEAETILDNITQSTQSFNDFTRVVGGEDAKPGQFPWQVVLNGKVDAFCGGSIVNEKWIVTAAHCVETGVKITVVAGEHNIEETEHTEQNRSVIRIIPHHNYNAAINKYNHDIALLELDEPLVLNSYVTPICIADKEYTNIFLKFGSGYVSGWGRVFHKGRSALVLQYLRVPLVDRATCLRSTKFRIYNNMFCAGFHEGGRDSCQGDSGGPHVTEVEGTSFLTGIISWGEECAMKGKYGIYTKVSEYVNWIKEKTKLT

SEQ ID NO: 368 - protein, 415 aa, Homo sapiens
  Factor IX Y155F/K247N/N249S/R318Y/R338E/T343R/R403E
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDFVNSTEAETILDNITQSTQSFNDFTRVVGGEDAKPGQFPWQVVLNGKVDAFCGGSIVNEKWIVTAAHCVETGVKITVVAGEHNIEETEHTEQNRSVIRIIPHHNYNAAINKYNHDIALLELDEPLVLNSYVTPICIADKEYTNIFLKFGSGYVSGWGRVFHKGYSALVLQYLRVPLVDRATCLESTKFRIYNNMFCAGFHEGGRDSCQGDSGGPHVTEVEGTSFLTGIISWGEECAMKGKYGIYTKVSEYVNWIKEKTKLT

SEQ ID NO: 369 - protein, 415 aa, Homo sapiens
  Factor IX K247N/N249S/R318Y/R338E/T343R/R403E
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQNRSVIRIIPHHNYNAAINKYNHDIALLELDEPLVLNSYVTPICIADKEYTNIFLKFGSGYVSGWGRVFHKGYSALVLQYLRVPLVDRATCLESTKFRIYNNMFCAGFHEGGRDSCQGDSGGPHVTEVEGTSFLTGIISWGEECAMKGKYGIYTKVSEYVNWIKEKTKLT

SEQ ID NO: 370 - protein, 415 aa, Homo sapiens
  Factor IX Y155F/K247N/N249S/R338E/T343R/ R403E/E410N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDFVNSTEAETILDNITQSTQSFNDFTRVVGGEDAKPGQFPWQVVLNGKVDAFCGGSIVNEKWIVTAAHCVETGVKITVVAGEHNIEETEHTEQNRSVIRIIPHHNYNAAINKYNHDIALLELDEPLVLNSYVTPICIADKEYTNIFLKFGSGYVSGWGRVFHKGRSALVLQYLRVPLVDRATCLESTKFRIYNNMFCAGFHEGGRDSCQGDSGGPHVTEVEGTSFLTGIISWGEECAMKGKYGIYTKVSEYVNWIKNKTKLT

SEQ ID NO: 371 - protein, 415 aa, Homo sapiens
  Factor IX K247N/N249S/R338E/T343R/R403E/E410N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQNRSVIRIIPHHNYNAAINKYNHDIALLELDEPLVLNSYVTPICIADKEYTNIFLKFGSGYVSGWGRVFHKGRSALVLQYLRVPLVDRATCLESTKFRIYNNMFCAGFHEGGRDSCQGDSGGPHVTEVEGTSFLTGIISWGEECAMKGKYGIYTKVSEYVNWIKNKTKLT

SEQ ID NO: 372 - protein, 415 aa, Homo sapiens
  Factor IX Y155F/K247N/N249S/R318Y/R338E
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDFVNSTEAETILDNITQSTQSFNDFTRVVGGEDAKPGQFPWQVVLNGKVDAFCGGSIVNEKWIVTAAHCVETGVKITVVAGEHNIEETEHTEQNRSVIRIIPHHNYNAAINKYNHDIALLELDEPLVLNSYVTPICIADKEYTNIFLKFGSGYVSGWGRVFHKGYSALVLQYLRVPLVDRATCLESTKFTIYNNMFCAGFHEGGRDSCQGDSGGPHVTEVEGTSFLTGIISWGEECAMKGKYGIYTKVSRYVNWIKEKTKLT

SEQ ID NO: 373 - protein, 415 aa, Homo sapiens
  Factor IX Y155F/K247N/N249S/R318Y/T343R
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDFVNSTEAETILDNITQSTQSFNDFTRVVGGEDAKPGQFPWQVVLNGKVDAFCGGSIVNEKWIVTAAHCVETGVKITVVAGEHNIEETEHTEQNRSVIRIIPHHNYNAAINKYNHDIALLELDEPLVLNSYVTPICIADKEYTNIFLKFGSGYVSGWGRVFHKGYSALVLQYLRVPLVDRATCLRSTKFRIYNNMFCAGFHEGGRDSCQGDSGGPHVTEVEGTSFLTGIISWGEECAMKGKYGIYTKVSRYVNWIKEKTKLT

SEQ ID NO: 374 - protein, 415 aa, Homo sapiens
  Factor IX Y155F/K247N/N249S/R318Y/R403E
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDFVNSTEAETILDNITQSTQSFNDFTRVVGGEDAKPGQFPWQVVLNGKVDAFCGGSIVNEKWIVTAAHCVETGVKITVVAGEHNIEETEHTEQNRSVIRIIPHHNYNAAINKYNHDIALLELDEPLVLNSYVTPICIADKEYTNIFLKFGSGYVSGWGRVFHKGYSALVLQYLRVPLVDRATCLRSTKFTIYNNMFCAGFHEGGRDSCQGDSGGPHVTEVEGTSFLTGIISWGEECAMKGKYGIYTKVSEYVNWIKEKTKLT

SEQ ID NO: 375 - protein, 415 aa, Homo sapiens
  Factor IX Y155F/K247N/N249S/R318Y/E410N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDFVNSTEAETILDNITQSTQSFNDFTRVVGGEDAKPGQFPWQVVLNGKVDAFCGGSIVNEKWIVTAAHCVETGVKITVVAGEHNIEETEHTEQNRSVIRIIPHHNYNAAINKYNHDIALLELDEPLVLNSYVTPICIADKEYTNIFLKFGSGYVSGWGRVFHKGYSALVLQYLRVPLVDRATCLRSTKFTIYNNMFCAGFHEGGRDSCQGDSGGPHVTEVEGTSFLTGIISWGEECAMKGKYGIYTKVSRYVNWIKNKTKLT

SEQ ID NO: 376 - protein, 415 aa, Homo sapiens
  Factor IX Y155F/K247N/N249S/R338E/R403E
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDFVNSTEAETILDNITQSTQSFNDFTRVVGGEDAKPGQFPWQVVLNGKVDAFCGGSIVNEKWIVTAAHCVETGVKITVVAGEHNIEETEHTEQNRSVIRIIPHHNYNAAINKYNHDIALLELDEPLVLNSYVTPICIADKEYTNIFLKFGSGYVSGWGRVFHKGRSALVLQYLRVPLVDRATCLESTKFTIYNNMFCAGFHEGGRDSCQGDSGGPHVTEVEGTSFLTGIISWGEECAMKGKYGIYTKVSEYVNWIKEKTKLT

SEQ ID NO: 377 - protein, 415 aa, Homo sapiens
  Factor IX Y155F/K247N/N249S/R338E/T343R
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDFVNSTEAETILDNITQSTQSFNDFTRVVGGEDAKPGQFPWQVVLNGKVDAFCGGSIVNEKWIVTAAHCVETGVKITVVAGEHNIEETEHTEQNRSVIRIIPHHNYNAAINKYNHDIALLELDEPLVLNSYVTPICIADKEYTNIFLKFGSGYVSGWGRVFHKGRSALVLQYLRVPLVDRATCLESTKFRIYNNMFCAGFHEGGRDSCQGDSGGPHVTEVEGTSFLTGIISWGEECAMKGKYGIYTKVSRYVNWIKEKTKLT

SEQ ID NO: 378 - protein, 415 aa, Homo sapiens
  Factor IX Y155F/K247N/N249S/R318Y/R338E/T343R/E410N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDFVNSTEAETILDNITQSTQSFNDFTRVVGGEDAKPGQFPWQVVLNGKVDAFCGGSIVNEKWIVTAAHCVETGVKITVVAGEHNIEETEHTEQNRSVIRIIPHHNYNAAINKYNHDIALLELDEPLVLNSYVTPICIADKEYTNIFLKFGSGYVSGWGRVFHKGYSALVLQYLRVPLVDRATCLESTKFRIYNNMFCAGFHEGGRDSCQGDSGGPHVTEVEGTSFLTGIISWGEECAMKGKYGIYTKVSRYVNWIKNKTKLT

SEQ ID NO: 379 - protein, 415 aa, Homo sapiens
  Factor IX K247N/N249S/R318Y/R338E/T343R/ E410N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQNRSVIRIIPHHNYNAAINKYNHDIALLELDEPLVLNSYVTPICIADKEYTNIFLKFGSGYVSGWGRVFHKGYSALVLQYLRVPLVDRATCLESTKFRIYNNMFCAGFHEGGRDSCQGDSGGPHVTEVEGTSFLTGIISWGEECAMKGKYGIYTKVSRYVNWIKNKTKLT

SEQ ID NO: 380 - protein, 415 aa, Homo sapiens
  Factor IX Y155F/K247N/N249S/R318Y/T343R/R403E/E410N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDFVNSTEAETILDNITQSTQSFNDFTRVVGGEDAKPGQFPWQVVLNGKVDAFCGGSIVNEKWIVTAAHCVETGVKITVVAGEHNIEETEHTEQNRSVIRIIPHHNYNAAINKYNHDIALLELDEPLVLNSYVTPICIADKEYTNIFLKFGSGYVSGWGRVFHKGYSALVLQYLRVPLVDRATCLRSTKFRIYNNMFCAGFHEGGRDSCQGDSGGPHVTEVEGTSFLTGIISWGEECAMKGKYGIYTKVSEYVNWIKNKTKLT

SEQ ID NO: 381 - protein, 415 aa, Homo sapiens
  Factor IX K247N/N249S/R318Y/T343R/R403E/E410N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQNRSVIRIIPHHNYNAAINKYNHDIALLELDEPLVLNSYVTPICIADKEYTNIFLKFGSGYVSGWGRVFHKGYSALVLQYLRVPLVDRATCLRSTKFRIYNNMFCAGFHEGGRDSCQGDSGGPHVTEVEGTSFLTGIISWGEECAMKGKYGIYTKVSEYVNWIKNKTKLT

SEQ ID NO: 382 - protein, 415 aa, Homo sapiens
  Factor IX Y155F/K247N/N249S/R338E/E410N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDFVNSTEAETILDNITQSTQSFNDFTRVVGGEDAKPGQFPWQVVLNGKVDAFCGGSIVNEKWIVTAAHCVETGVKITVVAGEHNIEETEHTEQNRSVIRIIPHHNYNAAINKYNHDIALLELDEPLVLNSYVTPICIADKEYTNIFLKFGSGYVSGWGRVFHKGRSALVLQYLRVPLVDRATCLESTKFTIYNNMFCAGFHEGGRDSCQGDSGGPHVTEVEGTSFLTGIISWGEECAMKGKYGIYTKVSRYVNWIKNKTKLT

SEQ ID NO: 383 - protein, 415 aa, Homo sapiens
  Factor IX Y155F/K247N/N249S/R318Y/T343R/ R403E
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDFVNSTEAETILDNITQSTQSFNDFTRVVGGEDAKPGQFPWQVVLNGKVDAFCGGSIVNEKWIVTAAHCVETGVKITVVAGEHNIEETEHTEQNRSVIRIIPHHNYNAAINKYNHDIALLELDEPLVLNSYVTPICIADKEYTNIFLKFGSGYVSGWGRVFHKGYSALVLQYLRVPLVDRATCLRSTKFRIYNNMFCAGFHEGGRDSCQGDSGGPHVTEVEGTSFLTGIISWGEECAMKGKYGIYTKVSEYVNWIKEKTKLT

SEQ ID NO: 384 - protein, 415 aa, Homo sapiens
  Factor IX K247N/N249S/R318Y/T343R/R403E
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQNRSVIRIIPHHNYNAAINKYNHDIALLELDEPLVLNSYVTPICIADKEYTNIFLKFGSGYVSGWGRVFHKGYSALVLQYLRVPLVDRATCLRSTKFRIYNNMFCAGFHEGGRDSCQGDSGGPHVTEVEGTSFLTGIISWGEECAMKGKYGIYTKVSEYVNWIKEKTKLT

SEQ ID NO: 385 - protein, 415 aa, Homo sapiens
  Factor IX Y155F/K247N/N249S/R318Y/T343R/E410N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDFVNSTEAETILDNITQSTQSFNDFTRVVGGEDAKPGQFPWQVVLNGKVDAFCGGSIVNEKWIVTAAHCVETGVKITVVAGEHNIEETEHTEQNRSVIRIIPHHNYNAAINKYNHDIALLELDEPLVLNSYVTPICIADKEYTNIFLKFGSGYVSGWGRVFHKGYSALVLQYLRVPLVDRATCLRSTKFRIYNNMFCAGFHEGGRDSCQGDSGGPHVTEVEGTSFLTGIISWGEECAMKGKYGIYTKVSRYVNWIKNKTKLT

SEQ ID NO: 386 - protein, 415 aa, Homo sapiens
  Factor IX K247N/N249S/R318Y/T343R/E410N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQNRSVIRIIPHHNYNAAINKYNHDIALLELDEPLVLNSYVTPICIADKEYTNIFLKFGSGYVSGWGRVFHKGYSALVLQYLRVPLVDRATCLRSTKFRIYNNMFCAGFHEGGRDSCQGDSGGPHVTEVEGTSFLTGIISWGEECAMKGKYGIYTKVSRYVNWIKNKTKLT

SEQ ID NO: 387 - protein, 415 aa, Homo sapiens
  Factor IX Y155F/K247N/N249S/R338E/T343R/ R403E
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDFVNSTEAETILDNITQSTQSFNDFTRVVGGEDAKPGQFPWQVVLNGKVDAFCGGSIVNEKWIVTAAHCVETGVKITVVAGEHNIEETEHTEQNRSVIRIIPHHNYNAAINKYNHDIALLELDEPLVLNSYVTPICIADKEYTNIFLKFGSGYVSGWGRVFHKGRSALVLQYLRVPLVDRATCLESTKFRIYNNMFCAGFHEGGRDSCQGDSGGPHVTEVEGTSFLTGIISWGEECAMKGKYGIYTKVSEYVNWIKEKTKLT

SEQ ID NO: 388 - protein, 415 aa, Homo sapiens
  Factor IX K247N/N249S/R338E/T343R/R403E
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQNRSVIRIIPHHNYNAAINKYNHDIALLELDEPLVLNSYVTPICIADKEYTNIFLKFGSGYVSGWGRVFHKGRSALVLQYLRVPLVDRATCLESTKFRIYNNMFCAGFHEGGRDSCQGDSGGPHVTEVEGTSFLTGIISWGEECAMKGKYGIYTKVSEYVNWIKEKTKLT

SEQ ID NO: 389 - protein, 415 aa, Homo sapiens
  Factor IX  Y155F/K247N/N249S/R338E/T343R/ E410N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDFVNSTEAETILDNITQSTQSFNDFTRVVGGEDAKPGQFPWQVVLNGKVDAFCGGSIVNEKWIVTAAHCVETGVKITVVAGEHNIEETEHTEQNRSVIRIIPHHNYNAAINKYNHDIALLELDEPLVLNSYVTPICIADKEYTNIFLKFGSGYVSGWGRVFHKGRSALVLQYLRVPLVDRATCLESTKFRIYNNMFCAGFHEGGRDSCQGDSGGPHVTEVEGTSFLTGIISWGEECAMKGKYGIYTKVSRYVNWIKNKTKLT

SEQ ID NO: 390 - protein, 415 aa, Homo sapiens
  Factor IX  K247N/N249S/R338E/T343R/E410N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQNRSVIRIIPHHNYNAAINKYNHDIALLELDEPLVLNSYVTPICIADKEYTNIFLKFGSGYVSGWGRVFHKGRSALVLQYLRVPLVDRATCLESTKFRIYNNMFCAGFHEGGRDSCQGDSGGPHVTEVEGTSFLTGIISWGEECAMKGKYGIYTKVSRYVNWIKNKTKLT

SEQ ID NO: 391 - protein, 415 aa, Homo sapiens
  Factor IX  Y155F/K247N/N249S/T343R/R403E/ E410N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDFVNSTEAETILDNITQSTQSFNDFTRVVGGEDAKPGQFPWQVVLNGKVDAFCGGSIVNEKWIVTAAHCVETGVKITVVAGEHNIEETEHTEQNRSVIRIIPHHNYNAAINKYNHDIALLELDEPLVLNSYVTPICIADKEYTNIFLKFGSGYVSGWGRVFHKGRSALVLQYLRVPLVDRATCLRSTKFRIYNNMFCAGFHEGGRDSCQGDSGGPHVTEVEGTSFLTGIISWGEECAMKGKYGIYTKVSEYVNWIKNKTKLT

SEQ ID NO: 392 - protein, 415 aa, Homo sapiens
  Factor IX  K247N/N249S/T343R/R403E/E410N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQNRSVIRIIPHHNYNAAINKYNHDIALLELDEPLVLNSYVTPICIADKEYTNIFLKFGSGYVSGWGRVFHKGRSALVLQYLRVPLVDRATCLRSTKFRIYNNMFCAGFHEGGRDSCQGDSGGPHVTEVEGTSFLTGIISWGEECAMKGKYGIYTKVSEYVNWIKNKTKLT

SEQ ID NO: 393 - protein, 415 aa, Homo sapiens
  Factor IX  Y155F/R318Y/R338E/T343R
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDFVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGYSALVLQYLRVPLVDRATCLESTKFRIYNNMFCAGFHEGGRDSCQGDSGGPHVTEVEGTSFLTGIISWGEECAMKGKYGIYTKVSRYVNWIKEKTKLT

SEQ ID NO: 394 - protein, 415 aa, Homo sapiens
  Factor IX  R318Y/R338E/T343R
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGYSALVLQYLRVPLVDRATCLESTKFRIYNNMFCAGFHEGGRDSCQGDSGGPHVTEVEGTSFLTGIISWGEECAMKGKYGIYTKVSRYVNWIKEKTKLT

SEQ ID NO: 395 - protein, 415 aa, Homo sapiens
  Factor IX  Y155F/R318Y/T343R/R403E
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDFVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGYSALVLQYLRVPLVDRATCLRSTKFRIYNNMFCAGFHEGGRDSCQGDSGGPHVTEVEGTSFLTGIISWGEECAMKGKYGIYTKVSEYVNWIKEKTKLT

SEQ ID NO: 396 - protein, 415 aa, Homo sapiens
  Factor IX  Y155F/T343R/R403E/E410N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDFVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFRIYNNMFCAGFHEGGRDSCQGDSGGPHVTEVEGTSFLTGIISWGEECAMKGKYGIYTKVSEYVNWIKNKTKLT

SEQ ID NO: 397 - protein, 415 aa, Homo sapiens
  Factor IX  Y155F/K247N/N249S/R318Y/R338E/ T343R
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDFVNSTEAETILDNITQSTQSFNDFTRVVGGEDAKPGQFPWQVVLNGKVDAFCGGSIVNEKWIVTAAHCVETGVKITVVAGEHNIEETEHTEQNRSVIRIIPHHNYNAAINKYNHDIALLELDEPLVLNSYVTPICIADKEYTNIFLKFGSGYVSGWGRVFHKGYSALVLQYLRVPLVDRATCLESTKFRIYNNMFCAGFHEGGRDSCQGDSGGPHVTEVEGTSFLTGIISWGEECAMKGKYGIYTKVSRYVNWIKEKTKLT

SEQ ID NO: 398 - protein, 415 aa, Homo sapiens
  Factor IX K247N/N249S/R318Y/R338E/T343R
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQNRSVIRIIPHHNYNAAINKYNHDIALLELDEPLVLNSYVTPICIADKEYTNIFLKFGSGYVSGWGRVFHKGYSALVLQYLRVPLVDRATCLESTKFRIYNNMFCAGFHEGGRDSCQGDSGGPHVTEVEGTSFLTGIISWGEECAMKGKYGIYTKVSRYVNWIKEKTKLT

SEQ ID NO: 399 - protein, 415 aa, Homo sapiens
  Factor IX Y155F/K247N/N249S/T343R/E410N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDFVNSTEAETILDNITQSTQSFNDFTRVVGGEDAKPGQFPWQVVLNGKVDAFCGGSIVNEKWIVTAAHCVETGVKITVVAGEHNIEETEHTEQNRSVIRIIPHHNYNAAINKYNHDIALLELDEPLVLNSYVTPICIADKEYTNIFLKFGSGYVSGWGRVFHKGRSALVLQYLRVPLVDRATCLRSTKFRIYNNMFCAGFHEGGRDSCQGDSGGPHVTEVEGTSFLTGIISWGEECAMKGKYGIYTKVSRYVNWIKNKTKLT

SEQ ID NO: 400 - protein, 415 aa, Homo sapiens
  Factor IX Y155F/K247N/N249S/R403E/E410N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDFVNSTEAETILDNITQSTQSFNDFTRVVGGEDAKPGQFPWQVVLNGKVDAFCGGSIVNEKWIVTAAHCVETGVKITVVAGEHNIEETEHTEQNRSVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSEYVNWIKNKTKLT

SEQ ID NO: 401 - protein, 415 aa, Homo sapiens
  Factor IX Y155F/R338E/T343R/E410N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDFVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLESTKFRIYNNMFCAGFHEGGRDSCQGDSGGPHVTEVEGTSFLTGIISWGEECAMKGKYGIYTKVSRYVNWIKNKTKLT

SEQ ID NO: 402 - protein, 415 aa, Homo sapiens
  Factor IX R338E/T343R/E410N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLESTKFRIYNNMFCAGFHEGGRDSCQGDSGGPHVTEVEGTSFLTGIISWGEECAMKGKYGIYTKVSRYVNWIKNKTKLT

SEQ ID NO: 403 - protein, 415 aa, Homo sapiens
  Factor IX Y155F/R318Y/T343R/E410N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDFVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGYSALVLQYLRVPLVDRATCLRSTKFRIYNNMFCAGFHEGGRDSCQGDSGGPHVTEVEGTSFLTGIISWGEECAMKGKYGIYTKVSRYVNWIKNKTKLT

SEQ ID NO: 404 - protein, 415 aa, Homo sapiens
  Factor IX R318Y/T343R/E410N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGYSALVLQYLRVPLVDRATCLRSTKFRIYNNMFCAGFHEGGRDSCQGDSGGPHVTEVEGTSFLTGIISWGEECAMKGKYGIYTKVSRYVNWIKNKTKLT

SEQ ID NO: 405 - protein, 415 aa, Homo sapiens
  Factor IX K228N/R318Y/R338E/T343R/R403E/ E410N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVNITVVAGEHNIEETEHTEQKRNVIRIIPHHNYNAAINKYNHDIALLELDEPLVLNSYVTPICIADKEYTNIFLKFGSGYVSGWGRVFHKGYSALVLQYLRVPLVDRATCLESTKFRIYNNMFCAGFHEGGRDSCQGDSGGPHVTEVEGTSFLTGIISWGEECAMKGKYGIYTKVSEYVNWIKNKTKLT

SEQ ID NO: 406 - protein, 415 aa, Homo sapiens
  Factor IX K228N/K247N/N249S/R318Y/R338E/ T343R/R403E
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVNITVVAGEHNIEETEHTEQNRSVIRIIPHHNYNAAINKYNHDIALLELDEPLVLNSYVTPICIADKEYTNIFLKFGSGYVSGWGRVFHKGYSALVLQYLRVPLVDRATCLESTKFRIYNNMFCAGFHEGGRDSCQGDSGGPHVTEVEGTSFLTGIISWGEECAMKGKYGIYTKVSEYVNWIKEKTKLT

SEQ ID NO: 407 - protein, 415 aa, Homo sapiens
  Factor IX K228N/K247N/N249S/R318Y/R338E/T343R/E410N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVNITVVAGEHNIEETEHTEQNRSVIRIIPHHNYNAAINKYNHDIALLELDEPLVLNSYVTPICIADKEYTNIFLKFGSGYVSGWGRVFHKGYSALVLQYLRVPLVDRATCLESTKFRIYNNMFCAGFHEGGRDSCQGDSGGPHVTEVEGTSFLTGIISWGEECAMKGKYGIYTKVSRYVNWIKNKTKLT

SEQ ID NO: 408 - protein, 415 aa, Homo sapiens
  Factor IX K228N/K247N/N249S/R318Y/T343R/ R403E/E410N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVNITVVAGEHNIEETEHTEQNRSVIRIIPHHNYNAAINKYNHDIALLELDEPLVLNSYVTPICIADKEYTNIFLKFGSGYVSGWGRVFHKGYSALVLQYLRVPLVDRATCLRSTKFRIYNNMFCAGFHEGGRDSCQGDSGGPHVTEVEGTSFLTGIISWGEECAMKGKYGIYTKVSEYVNWIKNKTKLT

SEQ ID NO: 409 - protein, 415 aa, Homo sapiens
  Factor IX Y155F/R338E/R403E/E410N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDFVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGEDSCQGDSGGPHVTEVEGTSFLTGIISWGEECAMKGKYGIYTKVSEYVNWIKNKTKLT

SEQ ID NO: 410 - protein, 415 aa, Homo sapiens
  Factor IX Y155F/R318Y/R338E/R403E
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDFVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGYSALVLQYLRVPLVDRATCLESTKFTIYNNMFCAGFHEGGRDSCQGDSGGPHVTEVEGTSFLTGIISWGEECAMKGKYGIYTKVSEYVNWIKEKTKLT

SEQ ID NO: 411 - protein, 415 aa, Homo sapiens
  Factor IX Y155F/R318Y/R403E/E410N
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDFVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGYSALVLQYLRVPLVDRATCLRSTKFTIYNNMFCAGFHEGGRDSCQGDSGGPHVTEVEGTSFLTGIISWGEECAMKGKYGIYTKVSEYVNWIKNKTKLT

SEQ ID NO: 412 - protein, 415 aa, Homo sapiens
  Factor IX Y1N
NNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 413 - protein, 415 aa, Homo sapiens
  Factor IX R318F
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGFSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 414 - protein, 415 aa, Homo sapiens
  Factor IX R318W
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGWSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 415 - protein, 415 aa, Homo sapiens
  Factor IX Y155L
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDLVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 416 - protein, 415 aa, Homo sapiens
  Factor IX T343D
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFDIYNNMFCAGFHEGGRDSCQGDSGGPHVTEVEGTSFLTGIISWGEECAMKGKYGIYTKVSRYVNWIKEKTKLT

SEQ ID NO: 417 - protein, 415 aa, Homo sapiens
  Factor IX R403D
YNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSDYVNWIKEKTKLT

The invention claimed is:

1. A modified FIX polypeptide, comprising the amino acid replacements R318Y, R338E and T343R in an unmodified FIX polypeptide, wherein:
   corresponding amino acid residues are identified by alignment of the unmodified FIX polypeptide with the polypeptide of SEQ ID NO:3;
   the unmodified FIX polypeptide comprises the sequence of amino acids set forth in any of SEQ ID NOS: 2, 3, 20 or 325, or a sequence of amino acid residues having at least 95% sequence identity to the FIX polypeptide sequence set forth in any of SEQ ID NOS: 2, 3, 20 or 325; and
   the modified FIX polypeptide, when an active form, exhibits one or both of increased catalytic activity and increased procoagulant activity compared with the unmodified FIX polypeptide.

2. The modified FIX polypeptide of claim 1, comprising an amino acid replacement at residue E410 or at an amino acid residue corresponding to 410 in an unmodified FIX polypeptide, wherein the replacement amino acid is N or S.

3. The modified FIX polypeptide of claim 2, wherein the amino acid replacement is N.

4. The modified FIX polypeptide of claim 1, comprising an amino acid replacement at residue 403 of a mature FIX polypeptide having a sequence set forth in SEQ ID NO:3 or at amino acid residues corresponding to residue 403 in an unmodified FIX polypeptide, wherein the replacement is E.

5. The modified FIX polypeptide of claim 1, comprising the amino acid replacements R318Y, R338E, T343R, R403E and E410N in a mature FIX polypeptide having a sequence set forth in SEQ ID NO: 3 or the same replacements at corresponding amino acid residues in an unmodified FIX polypeptide.

6. The modified FIX polypeptide of claim 1 that comprises amino acid replacements selected from among replacements R318Y/R338E/T343R/R403E/E410N, R318Y/R338E/T343R/E410N, Y155F/R318Y/R338E/T343R/R403E, Y155F/K228N/K247N/N249S/R318Y/R338E/T343R/R403E/E410N, Y155F/K247N/N249S/R318Y/R338E/T343R/R403E, K247N/N249S/R318Y/R338E/T343R/R403E, R318Y/R338E/T343R, Y155F/K247N/N249S/R318Y/R338E/T343R, K228N/R318Y/R338E/T343R/R403E/E410N, K228N/K247N/N249S/R318Y/R338E/T343R/R403E, R318Y/R338E/T343R/R403E/E410S, K247N/N249S/R318Y/R338E/T343R, K247N/N249S/R318Y/R338E/T343R/E410N, Y155F/K247N/N249S/R318Y/R338E/T343R/E410N, Y155F/K247N/N249S/R318Y/T343R/R403E/E410N, Y155F/R318Y/R338E/T343R and K228N/K247N/N249S/R318Y/R338E/T343R/E410N, or the same replacements at corresponding amino acid residues in an unmodified FIX polypeptide.

7. The modified FIX polypeptide of claim 1, comprising an amino acid replacement R318Y/R338E/T343R/R403E/E410N, R318Y/R338E/T343R/E410N, Y155F/R318Y/R338E/T343R/R403E, Y155F/K228N/K247N/N249S/R318Y/R338E/T343R/R403E/E410N, Y155F/K247N/N249S/R318Y/R338E/T343R/R403E, K247N/N249S/R318Y/R338E/T343R/R403E, R318Y/R338E/T343R, Y155F/K247N/N249S/R318Y/R338E/T343R, K228N/R318Y/R338E/T343R/R403E/E410N, K228N/K247N/N249S/R318Y/R338E/T343R/R403E, R318Y/R338E/T343R/R403E/E410S or K247N/N249S/R318Y/R338E/T343R.

8. The modified FIX polypeptide of claim 1, comprising amino acid replacements R318Y/R338E/T343R, R318Y/R338E/T343R/R403E/E410N or R318Y/R338E/T343R/E410N.

9. The modified FIX polypeptide of claim 1, further comprising the amino acid replacement Y155F or the same replacement at a corresponding amino acid residue in an unmodified FIX polypeptide.

10. A modified FIX polypeptide, comprising the sequence of amino acids set forth in any of SEQ ID NOS: 267, 330, 331, 334, 336, 345-348, 353, 354, 357-360, 366, 368, 369, 378, 379, 393, 394, 397, 398 and 405-407, or a sequence of amino acids that exhibits at least 95% amino acid sequence identity with the sequence of amino acids set forth in any of SEQ ID NOS: 267, 330, 331, 334, 336, 345-348, 353, 354, 357-360, 366, 368, 369, 378, 379, 393, 394, 397, 398 and 405-407 and comprises the amino replacements corresponding to R318Y, R338E and T343R, wherein corresponding replacements are identified by alignment with SEQ ID NO:3, wherein the modified FIX polypeptide, when activated, exhibits one or both of increased catalytic activity and increased procoagulant activity compared with the unmodified FIX polypeptide lacking the R318Y, R338E and T343R replacements.

11. The modified FIX polypeptide of claim 1 that comprises one or more modifications selected from a chemical modification or a post-translational modification, wherein the modified FIX polypeptide is glycosylated, carboxylated, hydroxylated, sulfated, phosphorylated, albuminated, or conjugated to a polyethylene glycol (PEG) moiety.

12. A pharmaceutical composition, comprising the modified FIX polypeptide of claim 1, in a pharmaceutically acceptable vehicle.

13. The pharmaceutical composition of claim 12 that is formulated for local, systemic, or topical administration.

14. The pharmaceutical composition of claim 12 that is formulated for oral, nasal, pulmonary, buccal, transdermal, subcutaneous, intraduodenal, enteral, parenteral, intravenous, or intramuscular administration.

15. The pharmaceutical composition of claim 12 that is formulated for controlled-release.

16. The pharmaceutical composition of claim 12 that is formulated for single-dosage administration.

17. An article of manufacture, comprising packaging material and the pharmaceutical composition of claim 12 contained within the packaging material.

18. A kit, comprising the pharmaceutical composition of claim 12, a device for administration of the composition and, optionally, instructions for administration.

19. The pharmaceutical composition of claim 12, wherein the modified FIX polypeptide comprises the sequence of amino acids set forth in SEQ ID NO:394.

20. A factor IX (FIX) polypeptide consisting of the polypeptide sequence of amino acid residues of SEQ ID NO:394.

21. The FIX polypeptide of claim 20 that is glycosylated.

22. The FIX polypeptide of claim 20 that is hyperglycosylated.

23. The modified FIX polypeptide of claim 1 that is hyperglycosylated.

24. The modified FIX polypeptide of claim 1 that is a mature polypeptide.

25. The modified FIX polypeptide of claim 1 that is a two-chain polypeptide.

26. The modified FIX polypeptide of claim 1 that is a single-chain polypeptide.

27. The modified FIX polypeptide of claim 1 that is activated.

28. A pharmaceutical composition, comprising the FIX polypeptide of claim 20, in a pharmaceutically acceptable vehicle.

29. A factor IX (FIX) polypeptide zymogen comprising the polypeptide sequence of amino acid residues of SEQ ID NO:394.

30. A method, comprising treating a subject by administering the pharmaceutical composition of claim 12, wherein the subject has a disease or condition that is treated by administration of FIX or a procoagulant.

31. The method of claim 30, wherein the disease or condition is treated by administration of active FIX (FIXa).

32. The method of claim 30, wherein treatment with the pharmaceutical composition ameliorates or alleviates the symptoms associated with the disease or condition.

33. The method of claim 30, further comprising monitoring the subject for changes in the symptoms associated with disease or condition that is treated by administration of FIX or a procoagulant.

34. The method of claim 30, wherein the disease or condition to be treated is selected from among blood coagulation disorders, hematologic disorders, hemorrhagic disorders, hemophilias, and bleeding disorders.

35. The method of claim 34, wherein the hemophilia is hemophilia B.

36. The method of claim 30, further comprising administering one or more additional coagulation factors.

37. The method of claim 36, wherein the one or more additional coagulation factors are selected from among plasma purified or recombinant coagulation factors, procoagulants, such as vitamin K, vitamin K derivative and protein C inhibitors, plasma, platelets, red blood cells and corticosteroids.

* * * * *

UNITED STATES PATENT AND TRADEMARK OFFICE
CERTIFICATE OF CORRECTION

| | | |
|---|---|---|
| PATENT NO. | : 8,778,870 B2 | Page 1 of 1 |
| APPLICATION NO. | : 13/373118 | |
| DATED | : July 15, 2014 | |
| INVENTOR(S) | : Madison et al. | |

It is certified that error appears in the above-identified patent and that said Letters Patent is hereby corrected as shown below:

IN THE CLAIMS:

Column 285, line 23 to line 27 should read:
  -- The modified FIX polypeptide of claim 1, comprising an amino acid replacement at residue 403 of a mature FIX polypeptide having a sequence set forth in SEQ ID NO:3 or at amino acid residues corresponding to residue 403 in an unmodified FIX polypeptide, wherein the replacement is E. --

Column 285, line 34 to line 51 should read:
  -- The modified FIX polypeptide of claim 1 that comprises amino acid replacements selected from among replacements R318Y/R338E/T343R/R403E/E410N, R318Y/R338E/T343R/E410N, Y155F/R318Y/R338E/T343R/R403E, Y155F/K228N/K247N/N249S/R318Y/R338E/T343R/R403E/E410N, Y155F/K247N/N249S/R318Y/R338E/T343R/R403E, K247N/N249S/R318Y/R338E/T343R/R403E, R318Y/R338E/T343R, Y155F/K247N/N249S/R318Y/R338E/T343R, K228N/R318Y/R338E/T343R/R403E/E410N, K228N/K247N/N249S/R318Y/R338E/T343R/R403E, R318Y/R338E/T343R/R403E/E410S, K247N/N249S/R318Y/R338E/T343R, K247N/N249S/R318Y/R338E/T343R/E410N, Y155F/K247N/N249S/R318Y/R338E/T343R/E410N, Y155F/K247N/N249S/R318Y/T343R/R403E/E410N, Y155F/R318Y/R338E/T343R and K228N/K247N/N249S/R318Y/R338E/T343R/E410N, or the same replacements at corresponding amino acid residues in an unmodified FIX polypeptide. --

Signed and Sealed this
Sixteenth Day of December, 2014

Michelle K. Lee
*Deputy Director of the United States Patent and Trademark Office*